United States Patent
Zelder et al.

(10) Patent No.: US 7,141,663 B2
(45) Date of Patent: Nov. 28, 2006

(54) GENES CODING FOR METABOLIC PATHWAY PROTEINS

(75) Inventors: Oskar Zelder, Speyer (DE); Markus Pompejus, Waldsee (DE); Hartwig Schröder, Nussloch (DE); Burkhard Kröger, Limburgerhof (DE); Corinna Klopprogge, Mannheim (DE); Gregor Haberhauer, Limburgerhof (DE)

(73) Assignee: BASF Aktiencesellschaft (DE)

( * ) Notice: Subject to any disclaimer, the term of this patent is extended or adjusted under 35 U.S.C. 154(b) by 281 days.

(21) Appl. No.: 10/494,675

(22) PCT Filed: Oct. 31, 2002

(86) PCT No.: PCT/EP02/12141

§ 371 (c)(1),
(2), (4) Date: May 4, 2004

(87) PCT Pub. No.: WO03/040681

PCT Pub. Date: May 15, 2003

(65) Prior Publication Data

US 2005/0019877 A1    Jan. 27, 2005

(30) Foreign Application Priority Data

Nov. 5, 2001 (DE) ................. 101 54 292

(51) Int. Cl.
*C07H 21/04* (2006.01)
*C12N 1/20* (2006.01)
*C12N 15/00* (2006.01)
*C12P 21/06* (2006.01)

(52) U.S. Cl. ............... 536/23.7; 435/69.1; 435/252.3; 435/320.1

(58) Field of Classification Search ........... 536/23.7; 435/69.1, 252.3, 320.1
See application file for complete search history.

(56) References Cited

FOREIGN PATENT DOCUMENTS

| EP | 0 854 189 A2 | 7/1998 |
|---|---|---|
| EP | 0 854 189 A3 | 7/1998 |
| EP | 1108790 A2 * | 6/2001 |
| WO | WO 01/66573 A2 | 9/2001 |
| WO | WO 01/66573 A3 | 9/2001 |

OTHER PUBLICATIONS

EMBL Accession No. AAB79689 for *Corynebacterium glutamicum* MP protein sequence SEQ ID No. 112.
EMBL Accession No. AAG90657 for *C glutamicum* protein fragment SEQ ID No. 4411.
EMBL Accession No. AX064189 for Sequence 471 from Patent WO0100843.
EMBL Accession No. AX127145 for Sequence 70561 from Patent EP1108790.

* cited by examiner

*Primary Examiner*—Mark Navarro
(74) *Attorney, Agent, or Firm*—Lahive & Cockfield LLP; Elizabeth A. Hanley; Maria Laccotripe Zacharakis

(57) ABSTRACT

The invention relates to novel nucleic acid molecules, to the use thereof for constructing genetically improved microorganisms and to methods for preparing fine chemicals, in particular amino acids, with the aid of said genetically improved microorganisms.

17 Claims, No Drawings

GENES CODING FOR METABOLIC PATHWAY PROTEINS

BACKGROUND OF THE INVENTION

Particular products and byproducts of naturally occurring metabolic processes in cells are used in many branches of industry, including the food industry, the animal feed industry, the cosmetics industry and the pharmaceutical industry. These molecules which are collectively referred to as "fine chemicals" comprise organic acids, both proteinogenic and nonproteinogenic amino acids, nucleotides and nucleosides, lipids and fatty acids, diols, carbohydrates, aromatic compounds, vitamins, cofactors and enzymes. They are best produced by means of cultivating, on a large scale, bacteria which have been developed to produce and secrete large amounts of one or more molecules of interest. An organism which is particularly suitable for this purpose is *Corynebacterium glutamicum*, a Gram-positive nonpathogenic bacterium. Using strain selection, a number of mutant strains have been developed which produce various desirable compounds. The selection of strains which are improved with respect to the production of a particular molecule is, however, a time-consuming and difficult process.

BRIEF DESCRIPTION OF THE INVENTION

The present invention provides novel nucleic acid molecules which can be used for identifying or classifying *Corynebacterium glutamicum* or related bacteria species. *C. glutamicum* is a Gram-positive aerobic bacterium which is widely used in industry for the large-scale production of a number of fine chemicals and also for the degradation of hydrocarbons (e.g. in the case of crude oil spills) and for the oxidation of terpenoids. The nucleic acid molecules may therefore be used for identifying microorganisms which can be used for producing fine chemicals, for example by fermentation processes. Although *C. glutamicum* itself is nonpathogenic, it is, however, related to other *Corynebacterium* species such as *Corynebacterium diphtheriae* (the diphtheria pathogen), which are major pathogens in humans. The ability to identify the presence of *Corynebacterium* species may therefore also be of significant clinical importance, for example in diagnostic applications. Moreover, said nucleic acid molecules may serve as reference points for mapping the *C. glutamicum* genome or the genomes of related organisms.

These novel nucleic acid molecules encode proteins which are referred to herein as metabolic pathway (MP) proteins. These MP proteins may, for example, exert a function which is involved in the transcriptional, translational or posttranslational regulation of proteins which are crucial for the normal metabolic functioning of cells. Owing to the availability of cloning vectors for use in *Corynebacterium glutamicum*, as disclosed, for example, in Sinskey et al., U.S. Pat. No. 4,649,119, and of techniques for the genetic manipulation of *C. glutamicum* and the related *Brevibacterium* species (e.g. *lactofermentum*) Yoshihama et al., J. Bacteriol. 162 (1985) 591–597; Katsumata et al., J. Bacteriol. 159 (1984) 306–311; and Santamaria et al. J. Gen. Microbiol. 130 (1984) 2237–2246), the nucleic acid molecules of the invention can be used for genetic manipulation of said organism in order to make it a better and more efficient producer of one or more fine chemicals.

The improved yield, production and/or efficiency of production of a fine chemical may be caused directly or indirectly by manipulating a gene of the invention. More specifically, modifications in *C. glutamicum* MP proteins which usually regulate the yield, production and/or efficiency of production of a fine chemical of a fine-chemical metabolic pathway may may have a direct effect on the total production or production rate of one or more of these desired compounds from said organism. Modifications in those proteins which are involved in these metabolic pathways may also have an indirect effect on the yield, production and/or efficiency of production of a desired fine chemical. Metabolic regulation is inevitably complex and the regulatory mechanisms which effect the different pathways may overlap in many places so that more than one metabolic pathway can be adjusted quickly according to a particular cellular event. This makes it possible for the modification of a regulatory protein for one metabolic pathway to also affect many other metabolic pathways, some of which may be involved in the biosynthesis or degradation of a fine chemical of interest. In this indirect manner, the modulation of the action of an MP protein may have an effect on the production of a fine chemical which is produced via a metabolic pathway different from that directly regulated by said MP protein.

The nucleic acid and protein molecules of the invention may be used in order to directly improve the yield, production and/or efficiency of production of one or more fine chemicals of interest from *Corynebacterium glutamicum*. It is possible, by means of gene recombination techniques known in the art, to manipulate one or more regulatory proteins of the invention such that their functions are modulated. The mutation of an MP protein which is involved in repressing the transcription of a gene encoding an enzyme required for the biosynthesis of an amino acid, such that said acid is no longer capable of repressing the transcription, may cause, for example, an increase in the production of said amino acid. Accordingly, modification of the activity of an MP protein, which causes an increased translation or activates posttranslational modification of a *C. glutamicum* protein involved in the biosynthesis of a fine chemical of interest, may in turn increase the production of said chemical. The opposite situation may likewise be useful: by increasing the repression of transcription or translation or by posttranslational negative modification of a *C. glutamicum* protein involved in regulating the degradation pathway of a compound, it is possible to increase the production of said chemical. In any case, the total yield or the production rate of the fine chemical of interest may be increased.

Likewise, it is possible that said modifications in the protein and nucleotide molecules of the invention may improve the yield, production and/or efficiency of production of fine chemicals via indirect mechanisms. The metabolism of a particular compound is inevitably linked to other biosynthetic and degradation pathways in the cell and necessary cofactors, intermediates or substrates of a metabolic pathway are probably provided or limited by another metabolic pathway. Modulating one or more regulatory proteins of the invention can therefore influence the efficiency of the activity of other biosynthetic or degradation pathways of fine chemicals. In addition to this, the manipulation of one or more regulatory proteins may increase the overall ability of the cell to grow and to propagate in culture, particularly in large-scale fermentation cultures in which the growth conditions may be suboptimal. It is possible to increase the biosynthesis of nucleosides and possibly cell division, for example by mutating an inventive MP protein which usually a repression of the biosynthesis of nucleosides as a reaction to a suboptimal extracellular supply of nutrients (thereby preventing cell division), such that said protein has a lower repressor activity. Modifications in those MP proteins which cause increased cell growth and increased cell division in culture may cause an increase in the yield, production and/or efficiency of production of one or more fine chemicals of interest from the culture, at least owing to the increased number of cells producing said chemical in culture.

The invention provides novel nucleic acid molecules encoding proteins which are referred to here as metabolic regulatory (MP) proteins and which are, for example, capable of carrying out an enzymic step which is involved in the transcriptional, translational or posttranslational regulation of metabolic pathways in *C. glutamicum*. Nucleic acid molecules which encode an MP protein are referred to here as MP nucleic acid molecules. In a preferred embodiment, the MP protein is involved in the transcriptional, translational or posttranslational regulation of one or more metabolic pathways. Examples of such proteins are those encoded by the genes listed in Table 1.

Consequently, one aspect of the invention relates to isolated nucleic acid molecules (e.g. cDNAs) comprising a nucleotide sequence which encodes an MP protein or biologically active sections thereof and nucleic acid fragments which are suitable as primers or hybridization probes for detecting or amplifying MP-encoding nucleic acid (e.g. DNA or mRNA). In particularly preferred embodiments, the isolated nucleic acid molecule comprises any of the nucleotide sequences listed in Appendix A or the coding region or a complement thereof of any of these nucleotide sequences. In other preferred embodiments, the isolated nucleic acid molecule encodes any of the amino acid sequences listed in Appendix B. The preferred MP proteins of the invention likewise have preferably at least one of the MP activities described herein.

Appendix A defines hereinbelow the nucleic acid sequences of the sequence listing together with the sequence modifications at the relevant position, described in Table 1.

Appendix B defines hereinbelow the polypeptide sequences of the sequence listing together with the sequence modifications at the relevant position, described in Table 1.

In a further embodiment, the isolated nucleic acid molecule is at least 15 nucleotides in length and hybridizes under stringent conditions to a nucleic acid molecule which comprises a nucleotide sequence of Appendix A. The isolated nucleic acid molecule preferably corresponds to a naturally occurring nucleic acid molecule. The isolated nucleic acid more preferably encodes a naturally occurring *C. glutamicum* MP protein or a biologically active section thereof.

Another aspect of the invention relates to vectors, for example recombinant expression vectors, which contain the nucleic acid molecules of the invention and to host cells into which said vectors have been introduced. In one embodiment, an MP protein is prepared by using a host cell which is cultivated in a suitable medium. The MP protein may then be isolated from the medium or the host cell.

Another aspect of the invention relates to a genetically modified microorganism into which an MP gene has been introduced or in which an MP gene has been modified. In one embodiment, the genome of said microorganism has been modified by introducing at least one inventive nucleic acid molecule which encodes the mutated MP sequence as transgene. In another embodiment, an endogenous MP gene in the genome of said microorganism has been modified, for example functionally disrupted, by homologous recombination with a modified MP gene. In a preferred embodiment, the microorganism belongs to the genus *Corynebacterium* or *Brevibacterium*, with *Corynebacterium glutamicum* being particularly preferred. In a preferred embodiment, the microorganism is also used for preparing a compound of interest, such as an amino acid, particularly preferably lysine.

Another preferred embodiment are host cells having more than one of the nucleic acid molecules described in Appendix A. Such host cells can be prepared in various ways known to the skilled worker. They may be transfected, for example, by vectors carrying several of the nucleic acid molecules of the invention. However, it is also possible to use a vector for introducing in each case one nucleic acid molecule of the invention into the host cell and therefore to use a plurality of vectors either simultaneously or sequentially. Thus it is possible to construct host cells which carry numerous, up to several hundred, nucleic acid sequences of the invention. Such an accumulation can often produce superadditive effects on the host cell with respect to fine-chemical productivity.

Another aspect of the invention relates to an isolated MP protein or to a section, for example a biologically active section, thereof. In a preferred embodiment, the isolated MP protein or the section thereof regulates transcriptionally, translationally or posttranslationally one or more metabolic pathways in *C. glutamicum*. In another preferred embodiment, the isolated MP protein or a section thereof is sufficiently homologous to an amino acid sequence of Appendix B for the protein or its section to be still capable of regulating transcriptionally, translationally or posttranslationally one or more metabolic pathways in *C. glutamicum*.

Moreover, the invention relates to an isolated MP-protein preparation. In preferred embodiments, the MP protein comprises an amino acid sequence of Appendix B. In a further preferred embodiment, the invention relates to an isolated full-length protein which is essentially homologous to a complete amino acid sequence of Appendix B (which is encoded by an open reading frame in Appendix A).

The MP polypeptide or a biologically active section thereof may be functionally linked to a non-MP polypeptide to produce a fusion protein. In preferred embodiments, this fusion protein has a different activity from that of the MP protein alone and, in other preferred embodiments, regulates transcriptionally, translationally or posttranslationally one or more metabolic pathways in *C. glutamicum*. In particularly preferred embodiments, integration of said fusion protein into a host cell modulates the production of a compound of interest by the cell.

Another aspect of the invention relates to a method for preparing a fine chemical. The method provides for the cultivation of a cell containing a vector which causes expression of an MP nucleic acid molecule of the invention so that a fine chemical is produced. In a preferred embodiment, this method additionally comprises the step of obtaining a cell containing such a vector, said cell being transfected with a vector which causes expression of an MP nucleic acid. In a further preferred embodiment, said method additionally comprises the step in which the fine chemical is obtained from the culture. In a preferred embodiment, the cell belongs to the genus *Corynebacterium* or *Brevibacterium*.

Another aspect of the invention relates to methods for modulating the production of a molecule from a microorganism. These methods comprise contacting the cell with a substance which modulates the MP-protein activity or MP nucleic-acid expression such that a cell-associated activity is modified in comparison with the same activity in the absence of said substance. In a preferred embodiment, the cell is modulated with respect to one or more regulatory systems for metabolic pathways in *C. glutamicum* so that this microorganism gives improved yields or an improved production rate of a fine chemical of interest. The substance which modulates the MP-protein activity stimulates, for example, MP-protein activity or MP nucleic-acid expression. Examples of substances stimulating MP-protein activity or MP nucleic-acid expression include small molecules, active MP proteins and nucleic acids which encode MP proteins and have been introduced into the cell. Examples of substances which inhibit MP activity or MP expression include small molecules and antisense MP nucleic acid molecules.

Another aspect of the invention relates to methods for modulating the yields of a compound of interest from a cell, comprising introducing an MP wild-type gene or MP-mutant gene into a cell, which gene either remains on a separate plasmid or is integrated into the genome of the host cell. Integration into the genome may take place randomly or via homologous recombination such that the native gene is replaced by the integrated copy, leading to the production of the compound of interest from the cell to be modulated. In a preferred embodiment, said yields are increased. In another preferred embodiment, the chemical is a fine chemical which, in a particularly preferred embodiment, is an amino acid. In a particularly preferred embodiment, this amino acid is L-lysine.

DETAILED DESCRIPTION OF THE INVENTION

The present invention provides MP nucleic-acid and MP-protein molecules which are involved in the regulation of the *Corynebacterium glutamicum* metabolism, including the regulation of the fine-chemical metabolism. The molecules of the invention can be used for modulating the production of fine chemicals from microorganisms such as *C. glutamicum* either directly (e.g. where modulation of the activity of a regulatory protein of the lysine metabolic pathway has a direct effect on the yield, production and/or efficiency of production of lysine from this organism) or indirectly, with the latter having nevertheless to an increase in the yield, production and/or efficiency of production of the compound of interest (e.g. where modulating the regulation of a nucleotide biosynthesis protein has an effect on the production of an organic acid or fatty acid from the bacterium, possibly owing to the accompanying regulatory modifications in the biosynthetic or degradation pathways for said chemicals as a reaction to the modified regulation of nucleotide biosynthesis). The aspects of the invention are further illustrated below.

I. Fine Chemicals

The term "fine chemical" is known in the art and includes molecules which are produced by an organism and are used in various branches of industry such as, for example, but not restricted to, the pharmaceutical industry, the agricultural industry and the cosmetics industry. These compounds comprise organic acids such as tartaric acid, itaconic acid and diaminopimelic acid, both proteinogenic and nonproteinogenic amino acids, purine and pyrimidine bases, nucleosides and nucleotides (as described, for example, in Kuninaka, A. (1996) Nucleotides and related compounds, pp. 561–612, in Biotechnology Vol. 6, Rehm et al., editors VCH: Weinheim and the references therein), lipids, saturated and unsaturated fatty acids (for example arachidonic acid), diols (e.g. propanediol and butanediol), carbohydrates (e.g. hyaluronic acid and trehalose), aromatic compounds (e.g. aromatic amines, vanillin and indigo), vitamins and cofactors (as described in Ullmann's Encyclopedia of Industrial Chemistry, Vol. A27, "Vitamins", pp. 443–613 (1996) VCH: weinheim and the references therein; and Ong, A. S., Niki, E. and Packer, L. (1995) "Nutrition, Lipids, Health and Disease" Proceedings of the UNESCO/Confederation of Scientific and Technological Associations in Malaysia and the Society for Free Radical Research—Asia, held Sep. 1–3, 1994, in Penang, Malaysia, AOCS Press (1995)), enzymes and all other chemicals described by Gutcho (1983) in Chemicals by Fermentation, Noyes Data Corporation, ISBN: 0818805086 and the references indicated therein. The metabolism and the uses of particular fine chemicals are further illustrated below.

A. Amino Acid Metabolism and Uses

Amino acids comprise the fundamental structural units of all proteins and are thus essential for normal functions of the cell. The term "amino acid" is known in the art. Proteinogenic amino acids, of which there are 20 types, serve as structural units for proteins, in which they are linked together by peptide bonds, whereas the nonproteinogenic amino acids (hundreds of which are known) usually do not occur in proteins (see Ullmann's Encyclopedia of Industrial Chemistry, Vol. A2, pp. 57–97 VCH: Weinheim (1985)). Amino acids can exist in the D or L configuration, although L-amino acids are usually the only type found in naturally occurring proteins. Biosynthetic and degradation pathways of each of the 20 proteinogenic amino acids are well characterized both in prokaryotic and eukaryotic cells (see, for example, Stryer, L. Biochemistry, 3rd edition, pp. 578–590 (1988)). The "essential" amino acids (histidine, isoleucine, leucine, lysine, methionine, phenylalanine, threonine, tryptophan and valine), so called because, owing to the complexity of their biosyntheses, they must be taken in with the diet, are converted by simple biosynthetic pathways into the other 11 "nonessential" amino acids (alanine, arginine, asparagine, aspartate, cysteine, glutamate, glutamine, glycine, proline, serine and tyrosine). Higher animals are able to synthesize some of these amino acids but the essential amino acids must be taken in with the food in order that normal protein synthesis takes place.

Apart from their function in protein biosynthesis, these amino acids are interesting chemicals as such, and it has been found that many have various applications in the food, animal feed, chemicals, cosmetics, agricultural and pharmaceutical industries. Lysine is an important amino acid not only for human nutrition but also for monogastric livestock such as poultry and pigs. Glutamate is most frequently used as flavor additive (monosodium glutamate, MSG) and elsewhere in the food industry, as are aspartate, phenylalanine, glycine and cysteine. Glycine, L-methionine and tryptophan are all used in the pharmaceutical industry. Glutamine, valine, leucine, isoleucine, histidine, arginine, proline, serine and alanine are used in the pharmaceutical industry and the cosmetics industry. Threonine, tryptophan and D/L-methionine are widely used animal feed additives (Leuchtenberger, W. (1996) Amino acids—technical production and use, pp. 466–502 in Rehm et al., (editors) Biotechnology Vol. 6, Chapter 14a, VCH: Weinheim). It has been found that these amino acids are additionally suitable as precursors for synthesizing synthetic amino acids and proteins, such as N-acetylcysteine, S-carboxymethyl-L-cysteine, (S)-5-hydroxytryptophan and other substances described in Ullmann's Encyclopedia of Industrial Chemistry, Vol. A2, pp. 57–97, VCH, Weinheim, 1985.

The biosynthesis of these natural amino acids in organisms able to produce them, for example bacteria, has been well characterized (for a review of bacterial amino acid biosynthesis and its regulation, see Umbarger, H. E. (1978) Ann. Rev. Biochem. 47: 533–606). Glutamate is synthesized by reductive amination of α-ketoglutarate, an intermediate product in the citric acid cycle. Glutamine, proline and arginine are each generated successively from glutamate. The biosynthesis of serine takes place in a three-step process and starts with 3-phosphoglycerate (an intermediate product of glycolysis), and affords this amino acid after oxidation, transamination and hydrolysis steps. Cysteine and glycine are each produced from serine, specifically the former by condensation of homocysteine with serine, and the latter by transfer of the side-chain β-carbon atom to tetrahydrofolate in a reaction catalyzed by serine transhydroxymethylase. Phenylalanine and tyrosine are synthesized from the precursors of the glycolysis and pentose phosphate pathway, and erythrose 4-phosphate and phosphoenolpyruvate in a 9-step biosynthetic pathway which diverges only in the last two steps after the synthesis of prephenate. Tryptophan is likewise produced from these two starting molecules but it is synthesized by an 11-step pathway. Tyrosine can also be prepared from phenylalanine in a reaction catalyzed by phenylalanine hydroxylase. Alanine, valine and leucine are each biosynthetic products derived from pyruvate, the final product of glycolysis. Aspartate is formed from oxalacetate, an intermediate product of the citrate cycle. Asparagine, methionine, threonine and lysine are each produced by the conversion of aspartate. Isoleucine is formed from threonine. Histidine is formed from 5-phosphoribosyl 1-pyrophosphate, an activated sugar, in a complex 9-step pathway.

Amounts of amino acids exceeding those required for protein biosynthesis by the cell cannot be stored and are instead broken down so that intermediate products are provided for the principal metabolic pathways in the cell (for a review, see Stryer, L., Biochemistry, 3rd edition, Chapter 21 "Amino Acid Degradation and the Urea Cycle"; pp. 495–516 (1988)). Although the cell is able to convert unwanted amino acids into the useful intermediate products of metabolism, production of amino acids is costly in terms of energy, the precursor molecules and the enzymes necessary for their synthesis. It is therefore not surprising that amino acid biosynthesis is regulated by feedback inhibition, whereby the presence of a particular amino acid slows down or completely stops its own production (for a review of the feedback mechanism in amino acid biosynthetic pathways, see Stryer, L., Biochemistry, 3rd edition, Chapter 24, "Biosynthesis of Amino Acids and Heme", pp. 575–600 (1988)). The output of a particular amino acid is therefore restricted by the amount of this amino acid in the cell.

B. Vitamins, Cofactors and Nutraceutical Metabolism, and Uses

Vitamins, cofactors and nutraceuticals comprise another group of molecules. Higher animals have lost the ability to synthesize them and therefore have to take them in, although they are easily synthesized by other organisms such as bacteria. These molecules are either bioactive molecules per se or precursors of bioactive substances which serve as electron carriers or intermediate products in a number of metabolic pathways. Besides their nutritional value, these compounds also have a significant industrial value as colorants, antioxidants and catalysts or other processing auxiliaries. (For a review of the structure, activity and industrial applications of these compounds, see, for example, Ullmann's Encyclopedia of Industrial Chemistry, "Vitamins", Vol. A27, pp. 443–613, VCH: Weinheim, 1996). The term "vitamin" is known in the art and comprises nutrients which are required for normal functioning of an organism but cannot be synthesized by this organism itself. The group of vitamins may include cofactors and nutraceutical compounds. The term "cofactor" comprises nonproteinaceous compounds necessary for the appearance of normal enzymic activity. These compounds may be organic or inorganic; the cofactor molecules of the invention are referably organic. The term "nutraceutical" comprises food additives which are health-promoting in plants and animals, especially humans. Examples of such molecules are vitamins, antioxidants and likewise certain lipids (e.g. polyunsaturated fatty acids).

The biosynthesis of these molecules in organisms able to produce them, such as bacteria, has been comprehensively characterized (Ullmann's Encyclopedia of Industrial Chemistry, "Vitamins", Vol. A27, pp. 443–613, VCH: Weinheim, 1996, Michal, G. (1999) Biochemical Pathways: An Atlas of Biochemistry and Molecular Biology, John Wiley & Sons; Ong, A. S., Niki, E. and Packer, L. (1995) "Nutrition, Lipids, Health and Disease" Proceedings of the UNESCO/Confederation of Scientific and Technological Associations in Malaysia and the Society for Free Radical Research-Asia, held on Sep. 1–3, 1994, in Penang, Malaysia, AOCS Press, Champaign, Ill. X, 374 S).

Thiamine (vitamin $B_1$) is formed by chemical coupling of pyrimidine and thiazole units. Riboflavin (vitamin $B_2$) is synthesized from guanosine 5'-triphosphate (GTP) and ribose 5'-phosphate. Riboflavin in turn is employed for the synthesis of flavin mononucleotide (FMN) and flavin adenine dinucleotide (FAD). The family of compounds together referred to as "vitamin B6" (for example pyridoxine, pyridoxamine, pyridoxal 5'-phosphate and the commercially used pyridoxine hydrochloride), are all derivatives of the common structural unit 5-hydroxy-6-methylpyridine. Pantothenate (pantothenic acid, R-(+)-N-(2,4-dihydroxy-3, 3-dimethyl-1-oxobutyl)-β-alanine) can be prepared either by chemical synthesis or by fermentation. The last steps in pantothenate biosynthesis consist of ATP-driven condensation of β-alanine and pantoic acid. The enzymes responsible for the biosynthetic steps for the conversion into pantoic acid and into β-alanine and for the condensation to pantothenic acid are known. The metabolically active form of pantothenate is coenzyme A whose biosynthesis takes place by 5 enzymatic steps. Pantothenate, pyridoxal 5'-phosphate, cysteine and ATP are the precursors of coenzyme A. These enzymes catalyze not only the formation of pantothenate but also the production of (R)-pantoic acid, (R)-pantolactone, (R)-panthenol (provitamin $B_5$), pantetheine (and its derivatives) and coenzyme A.

The biosynthesis of biotin from the precursor molecule pimeloyl-CoA in microorganisms has been investigated in detail, and several of the genes involved have been identified. It has emerged that many of the corresponding proteins are involved in the Fe cluster synthesis and belong to the class of nifS proteins. Liponic acid is derived from octanonoic acid and serves as coenzyme in energy metabolism where it is a constituent of the pyruvate dehydrogenase complex and of the α-ketoglutarate dehydrogenase complex. Folates are a group of substances all derived from folic acid which in turn is derived from L-glutamic acid, p-aminobenzoic acid and 6-methylpterin. The biosynthesis of folic acid and its derivatives starting from the metabolic intermediate products of the biotransformation of guanosine 5'-triphosphate (GTP), L-glutamic acid and p-aminobenzoic acid has been investigated in detail in certain microorganisms.

Corrinoids (such as the cobalamines and, in particular, vitamin $B_{12}$) and the porphyrins belong to a group of chemicals distinguished by a tetrapyrrole ring system. The biosynthesis of vitamin $B_{12}$ is so complex that it has not yet been completely characterized, but many of the enzymes and substrates involved are now known. Nicotinic acid (nicotinate) and nicotinamide are pyridine derivatives which are also referred to as "niacin". Niacin is the precursor of the important coenzymes NAD (nicotinamide adenine dinucleotide) and NADP (nicotinamide adenine dinucleotide phosphate) and their reduced forms.

Production of these compounds on the industrial scale is mostly based on cell-free chemical syntheses, although some of these chemicals have likewise been produced by large-scale cultivation of microorganisms, such as riboflavin, vitamin $B_6$, pantothenate and biotin. Only vitamin $B_{12}$ is, because of the complexity of its synthesis, produced only by fermentation. In vitro processes require a considerable expenditure of materials and time and frequently high costs.

C. Purine, Pyrimidine, Nucleoside and Nucleotide Metabolism and Uses

Genes for purine and pyrimidine metabolism and their corresponding proteins are important aims for the therapy of oncoses and viral infections. The term "purine" or "pyrimidine" comprises nitrogen-containing bases which form part of nucleic acids, coenzymes and nucleotides. The term "nucleotide" encompasses the fundamental structural units of nucleic acid molecules, which comprise a nitrogen-containing base, a pentose sugar (the sugar is ribose in the case of RNA and the sugar is D-deoxyribose in the case of DNA) and phosphoric acid. The term "nucleoside" comprises molecules which serve as precursors of nucleotides but have, in contrast to the nucleotides, no phosphoric acid unit. It is possible to inhibit RNA and DNA synthesis by inhibiting the biosynthesis of these molecules or their mobilization to form nucleic acid molecules; targeted inhibition of this activity in cancerogenic cells allows the ability of tumor cells to divide and replicate to be inhibited.

There are also nucleotides which do not form nucleic acid molecules but serve as energy stores (i.e. AMP) or as coenzymes (i.e. FAD and NAD).

Several publications have described the use of these chemicals for these medical indications, the purine and/or pyrimidine metabolism being influenced (for example Christopherson, R. I. and Lyons, S. D. (1990) "Potent inhibitors of de novo pyrimidine and purine biosynthesis as chemotherapeutic agents", Med. Res. Reviews 10: 505–548). Investigations of enzymes involved in purine and pyrimidine metabolism have concentrated on the development of novel medicaments which can be used, for example, as immunosuppressants or antiproliferative agents (Smith, J. L. "Enzymes in Nucleotide Synthesis" Curr. Opin. Struct. Biol. 5 (1995) 752–757; Biochem. Soc. Transact. 23 (1995) 877–902). However, purine and pyrimidine bases, nucleosides and nucleotides also have other possible uses: as intermediate products in the biosynthesis of various fine chemicals (e.g. thiamine, S-adenosylmethionine, folates or riboflavin), as energy carriers for the cell (for example ATP or GTP) and for chemicals themselves, are ordinarily used as flavor enhancers (for example IMP or GMP) or for many medical applications (see, for example, Kuninaka, A., (1996) "Nucleotides and Related Compounds in Biotechnology" Vol. 6, Rehm et al., editors VCH: Weinheim, pp. 561–612). Enzymes involved in purine, pyrimidine, nucleoside or nucleotide metabolism are also increasingly serving as targets against which chemicals are being developed for crop protection, including fungicides, herbicides and insecticides.

The metabolism of these compounds in bacteria has been characterized (for reviews, see, for example, Zalkin, H. and Dixon, J. E. (1992) "De novo purine nucleotide biosynthesis" in Progress in Nucleic Acids Research and Molecular biology, Vol. 42, Academic Press, pp. 259–287; and Michal, G. (1999) "Nucleotides and Nucleosides"; Chapter 8 in : Biochemical Pathways: An Atlas of Biochemistry and Molecular Biology, Wiley, New York). Purine metabolism, the object of intensive research, is essential for normal functioning of the cell. Disordered purine metabolism in higher animals may cause severe illnesses, for example gout. Purine nucleotides are synthesized from ribose 5-phosphate by a number of steps via the intermediate compound inosine 5'-phosphate (IMP), leading to the production of guanosine 5'-monophosphate (GMP) or adenosine 5'-monophosphate (AMP), from which the triphosphate forms used as nucleotides can easily be prepared. These compounds are also used as energy stores, so that breakdown thereof provides energy for many different biochemical processes in the cell. Pyrimidine biosynthesis takes place via formation of uridine 5'-monophosphate (UMP) from ribose 5-phosphate. UMP in turn is converted into cytidine 5'-triphosphate (CTP). The deoxy forms of all nucleotides are prepared in a one-step reduction reaction from the diphosphate ribose form of the nucleotide to give the diphosphate deoxyribose form of the nucleotide. After phosphorylation, these molecules can take part in DNA synthesis.

D. Trehalose Metabolism and Uses

Trehalose consists of two glucose molecules linked together by $\alpha,\alpha$-1,1 linkage. It is ordinarily used in the food industry as sweetener, as additive for dried or frozen foods and in beverages. However, it is also used in the pharmaceutical industry or in the cosmetics industry and biotechnology industry (see, for example, Nishimoto et al., (1998) U.S. Pat. No. 5,759,610; Singer, M. A. and Lindquist, S. Trends Biotech. 16 (1998) 460–467; Paiva, C. L. A. and Panek, A. D. Biotech Ann. Rev. 2 (1996) 293–314; and Shiosaka, M. J. Japan 172 (1997) 97–102). Trehalose is produced by enzymes of many microorganisms and is naturally released into the surrounding medium from which it can be isolated by methods known in the art.

II. Mechanisms of Metabolic Regulation

All living cells have complex catabolic and anabolic capabilities with many metabolic pathways linked to one another. In order to maintain an equilibrium between the various parts of this extremely complex metabolic network, the cell employs a finely tuned regulatory network. By regulating the enzyme synthesis and enzyme activity, either independently or simultaneously, the cell can regulate the activity of completely different metabolic pathways so as to meet the cell's changing needs.

The induction or repression of enzyme synthesis may take place either at the transcriptional or the translational level or at both levels (for a review, see Lewin, B. (1990) Genes IV, Part 3: "Controlling prokaryotic genes by transcription", Oxford University Press, Oxford, pp. 213–301, and the references therein, and Michal, G. (1999) Biochemical Pathways: An Atlas of Biochemistry and Molecular Biology, John Wiley & Sons). All of these known regulatory processes are mediated by additional genes which themselves react to various external influences (e.g. temperature, nutrient supply or light). Examples of protein factors involved in this type of regulation include the transcription factors. These are proteins which bind to the DNA, thereby causing the expression of a gene either to increase (positive regulation as in the case of the *E. coli* ara operon) or to decrease (negative regulation as in the case of the *E. coli* lac operon). These expression-modulating transcription factors may themselves be subject to regulation. Their activity may be regulated, for example, by low molecular weight compounds binding to the DNA-binding protein, whereby binding of said proteins to the appropriate binding site on the DNA is stimulated (as in the case of arabinose for the ara operon) or inhibited (as in the case of lactose for the lac operon) (see, for example, Helmann, J. D. and Chamberlin, M. J. (1988) "Structure and function of bacterial sigma factors" Ann. Rev. Biochem. 57: 839–872; Adhya, S. (1995) "The lac and gal operons today" and Boos, W. et al., "The maltose system", both in Regulation of Gene Expression in *Escherichia coli* (Lin, E. C. C. and Lynch, A. S. editors) Chapman & Hall: New York, pp. 181–200 and 201–229; and Moran, C. P. (1993) "RNA polymerase and transcription factors" in: *Bacillus subtilis* and other Gram-positive bacteria, Sonenshein, A. L. editors ASM: Washington D.C. pp. 653–667).

Protein synthesis is regulated not only at the transcriptional level but often also at the translational level. This regulation can be carried out via many mechanisms, including modification of the ability of the ribosome to bind to one or more mRNAs, the binding of the ribosome to mRNA, maintaining or removing of the mRNA secondary structure, using common or less common codons for a particular gene, the degree of abundance of one or more tRNAs and specific regulatory mechanisms such as attenuation (see Vellanoweth, R. I. (1993) Translation and its regulation in *Bacillus subtilis* and other Gram-positive bacteria, Sonenshein, A. L. et al. editors ASM: Washington, D.C., pp. 699–711 and references therein.

The transcriptional and translational regulation may be directed toward a single protein (sequential regulation) or simultaneously toward a plurality of proteins in various metabolic pathways (coordinated regulation). Genes whose expression is regulated in a coordinated fashion are often located in the genome in close proximity in an operon or regulon. This up or down regulation of gene transcription and gene translation is controlled by the cellular or extracellular amounts of various factors such as substrates (precursors and intermediates which are used in one or more metabolic pathways), catabolites (molecules produced by biochemical pathways which are connected with energy production from the degradation of complex organic molecules such as sugars) and end products (molecules which are obtained at the end of a metabolic pathway). The expression of genes which encode enzymes required for the activity of a particular metabolic pathway is induced by large amounts of substrate molecules for said metabolic pathway. Correspondingly, this gene expression is repressed by the presence of large intracellular amounts of the end product of the pathway (Snyder, L. and Champness, W. (1977) The Molecular Biology of Bacteria ASM: Washington). The gene expression may likewise be regulated by other external and internal factors such as environmental conditions (e.g. heat, oxidative stress or hunger). These global environmental changes cause changes in the expression of specialized modulating genes which trigger gene expression directly or indirectly (via additional genes or proteins) by binding to DNA and thereby induce or repress transcription (see, for example, Lin, E. C. C. and Lynch, A. S. editors (1995) Regulation of Gene Expression in *Escherichia coli*, Chapman & Hall: New York).

Another mechanism by which the cellular metabolism can be regulated takes place at the protein level. This regulation is carried out either via the activities of other enzymes or via binding of low molecular weight components which prevent or enable normal function of the protein. Examples of protein regulation by binding of low molecular weight compounds include the binding of GTP or NAD. The binding of low molecular weight chemicals is usually reversible, for example in the case of GTP-binding proteins. These proteins occur in two states (with bound GTP or GDP), with one state being the active form of the protein and the other one the inactive form.

The protein activity is regulated by the action of other enzymes usually via covalent modification of the protein (i.e. phosphorylation of amino acid residues such as histidine or aspartate or methylation). This covalent modification is usually reversible and this is effected by an enzyme having the opposite activity. An example for this is the opposite activity of kinases and phosphorylases in protein phosphorylation: protein kinases phosphorylate specific residues on a target protein (e.g. serine or threonine), whereas protein phosphorylases remove the phosphate groups from said proteins. Enzymes modulating the activity of other proteins are usually modulated themselves by external stimuli. These stimuli are mediated by proteins acting as sensors. A well-known mechanism by which these sensor proteins mediate said external signals is dimerization, but other mechanisms are also known (see, for example, Msadek, T. et al. (1993) "Two-component Regulatory Systems" in: *Bacillus subtilis* and Other Gram-Positive Bacteria, Sonenshein, A. L. et al., editors, ASM: Washington, pp. 729–745 and references therein).

A detailed understanding of the regulatory networks which control the cellular metabolism in microorganisms is crucial for the production of chemicals in high yields by fermentation. Control systems for downregulating the metabolic pathways may be removed or reduced in order to improve the synthesis of chemicals of interest and, correspondingly, those for upregulation of the metabolic pathway of a product of interest may be constitutively activated or optimized with respect to the activity (as shown in Hirose, Y. and Okada, H. (1979) "Microbial Production of Amino Acids", in: Peppler, H. J. and Perlman, D. (editors) Microbial Technology 2nd edition, Vol. 1, Chapter 7, Academic Press, New York).

III. Elements and Methods of the Invention

The present invention is based, at least partially, on the detection of new molecules which are referred to herein as MP nucleic-acid and MP-protein molecules and which regulate one or more metabolic pathways in *C. glutamicum* by transcriptional, translational or posttranslational measures. In one embodiment, the MP molecules regulate transcriptionally, translationally or posttranslationally a metabolic pathway in *C. glutamicum*. In a preferred embodiment, the activity of the inventive MP molecules for regulating one or more metabolic pathways in *C. glutamicum* has an effect on the production of a fine chemical of interest by said organism. In a particularly preferred embodiment, the MP molecules of the invention have a modulated activity so that the *C. glutamicum* metabolic pathways regulated by the MP proteins of the invention are modulated with respect to their efficiency or their throughput and this modulates either directly or indirectly the yield, production and/or efficiency of production of a fine chemical of interest by *C. glutamicum*.

The term "MP protein" or "MP polypeptide" comprises proteins which regulate transcriptionally, translationally or posttranslationally a metabolic pathway in *C. glutamicum*. Examples of MP proteins comprise those which are encoded by the MP genes listed in Table 1 and Appendix A. The terms "MP gene" and "MP nucleic acid sequence" comprise nucleic acid sequences encoding an MP protein which comprises a coding region and corresponding untranslated 5' and 3' sequence regions. Examples of MP genes are listed in Table 1. The terms "production" and "productivity" are known in the art and include the concentration of the fermentation product (for example the fine chemical of interest, which is produced within a predetermined time interval and a predetermined fermentation volume (e.g. kg of product per h per l). The term "efficiency of production" comprises the time required for attaining a particular production quantity (for example, the time required by the cell for reaching a particular throughput rate of a fine chemical). The term "yield" or "product/carbon yield" is known in the art and comprises the efficiency of converting the carbon source into the product (i.e. the fine chemical). This is, for example, usually expressed as kg of product per kg of carbon source. Increasing the yield or production of the compound increases the amount of the molecules obtained or of the suitable obtained molecules of this compound in a particular culture volume over a predetermined period. The terms "biosynthesis" and "biosynthetic pathway" are known in the art and comprise the synthesis of a compound, preferably an organic compound, from intermediates by a cell, for example in a multistep process or highly regulated process. The terms "degradation" and "degradation pathway" are known in the art and comprise cleavage of a compound, preferably an organic compound, into degradation products (in more general terms: smaller or less complex molecules) by a cell, for example in a multistep process or highly regulated process. The term "metabolism" is known in the art and comprises the entirety of biochemical reactions which take place in an organism. The metabolism of a particular compound (e.g. the metabolism of an amino acid such as glycine) then comprises all biosynthetic, modification and degradation pathways of this compound in the cell. The term "regulation" is known in the art and comprises the activity of a protein for controlling the activity of another protein. The term "transcriptional regulation" is known in the art and comprises the activity of a protein for inhibiting or activating the conversion of a DNA encoding a target protein into mRNA. The term "translational regulation" is known in the art and comprises the activity of a protein for inhibiting or activating conversion of an mRNA encoding a target protein into a protein molecule. The term "posttranslational regulation" is known in the art and comprises the activity of a protein for inhibiting or improving the activity of a target protein by covalently modifying the target protein (e.g. by methylation, glycosylation or phosphorylation).

In another embodiment the MP molecules of the invention are capable of modulating the production of a molecule of interest, such as a fine chemical, in a microorganism such as C. glutamicum. With the aid of gene recombination techniques it is possible to manipulate one or more inventive regulatory proteins for metabolic pathways such that their function is modulated. It is possible, for example, to improve a biosynthesis enzyme with respect to efficiency or to destroy its allosteric control region so that feedback inhibition of the production of the compound is prevented. Accordingly, a degradation enzyme can be deleted or be modified by substitution, deletion or addition such that its degradation activity for the compound of interest is reduced, without impairing cell viability. In any case, it is possible to increase the overall yield or production rate of any of said fine chemicals of interest.

It is also possible that these modifications in the protein and nucleotide molecules of the invention can improve the production of fine chemicals indirectly. The regulatory mechanisms of the metabolic pathways in the cell are inevitably linked and activation of one metabolic pathway can cause repression or activation of another metabolic pathway in an accompanying manner. Modulating the activity of one or more proteins of the invention can influence the production or the efficiency of the activity of other fine-chemical biosynthetic or degradation pathways. Reducing the ability of an MP protein to repress the transcription of a gene which encodes a particular protein in amino acid biosynthesis makes it possible to simultaneously derepress other amino acid biosynthetic pathways, since these metabolic pathways are linked to one another. By modifying the MP proteins of the invention it is possible to decouple to a certain degree cell growth and cell division from their extracellular environments; by influencing an MP protein which usually represses the biosynthesis of a nucleotide when the extracellular conditions for growth and cell division are suboptimal such that it now lacks this function, it is possible to enable growth even if the extracellular conditions are poor. This is of particular importance for large-scale fermentative cultivation for which the culture conditions with respect to temperature, nutrient supply or aeration are often suboptimal but can still promote growth and cell division, after the cellular regulatory systems for said factors have been eliminated.

A suitable starting point for preparing the nucleic acid sequences of the invention is the genome of a Corynebacterium glutamicum strain which can be obtained from the American Type Culture Collection under the name ATCC 13032.

The nucleic acid sequences of the invention can be prepared from these nucleic acid sequences via the modifications denoted in Table 1, using conventional methods.

The MP protein of the invention or a biologically active section or fragments thereof can regulate transcriptionally, translationally or posttranslationally a metabolic pathway in C. glutamicum or can have one or more of the activities listed in Table 1.

The following subsections describe various aspects of the invention in more detail:

A. Isolated Nucleic Acid Molecules

One aspect of the invention relates to isolated nucleic acid molecules which encode MP polypeptides or biologically active sections thereof and to nucleic acid fragments which are sufficient for use as hybridization probes or primers for identifying or amplifying MP-encoding nucleic acids (e.g. MP DNA). The term "nucleic acid molecule", as used herein, is intended to comprise DNA molecules (e.g. cDNA or genomic DNA) and RNA molecules (e.g. mRNA) and also DNA or RNA analogs which are generated by means of nucleotide analogs. Moreover, this term comprises the untranslated sequence located at the 3' and 5' ends of the coding gene region: at least about 100 nucleotides of the sequence upstream of the 5' end of the coding region and at least about 20 nucleotides of the sequence downstream of the 3' end of the coding gene region. The nucleic acid molecule may be single-stranded or double-stranded but is preferably a double-stranded DNA. An "isolated" nucleic acid molecule is removed from other nucleic acid molecules which are present in the natural source of the nucleic acid. An "isolated" nucleic acid preferably does not have any sequences which flank the nucleic acid naturally in the genomic DNA of the organism from which the nucleic acid originates (for example sequences located at the 5' or 3' end of the nucleic acid). In various embodiments, the isolated MP nucleic acid molecule may, for example, less than about 5 kb, 4 kb, 3 kb, 2 kb, 1 kb, 0.5 kb or 0.1 kb of the nucleotide sequences which naturally flank the nucleic acid molecule in the genomic DNA of the cell from which the nucleic acid originates (e.g. a *C. glutamicum* cell). In addition to this, an "isolated" nucleic acid molecule, such as a cDNA molecule, may be essentially free of another cellular material or culture medium, if prepared by recombinant techniques, or free of chemical precursors or other chemicals, if it is chemically synthesized.

A nucleic acid molecule of the invention, for example a nucleic acid molecule having a nucleotide sequence of Appendix A or a section thereof, may be prepared by means of molecular biological standard techniques and the sequence information provided here. For example, a *C. glutamicum* MP cDNA may be isolated from a *C. glutamicum* bank by using a complete sequence from Appendix A or a section thereof as hybridization probe and by using standard hybridization techniques (as described, for example, in Sambrook, J., Fritsch, E. F. and Maniatis, T. Molecular Cloning: A Laboratory Manual. 2nd Ed. Cold Spring Harbor Laboratory, Cold Spring Harbor Laboratory Press, Cold Spring Harbor, N.Y., 1989). Moreover, a nucleic acid molecule comprising a complete sequence from Appendix A or a section thereof can be isolated via polymerase chain reaction, using the oligonucleotide primers produced on the basis of said sequence (for example, it is possible to isolate a nucleic acid molecule comprising a complete sequence from Appendix A or a section thereof via polymerase chain reaction by using oligonucleotide primers which have been produced on the basis of this same sequence from Appendix A). For example, mRNA can be isolated from normal endothelial cells (for example via the guanidinium-thiocyanate extraction method of Chirgwin et al. (1979) Biochemistry 18: 5294–5299), and the cDNA can be prepared by means of reverse transcriptase (e.g. Moloney-MLV reverse transcriptase, available from Gibco/BRL, Bethesda, Md., or AMV reverse transcriptase, available from Seikagaku America, Inc., St. Petersburg, Fla.). Synthetic oligonucleotide primers for amplification via polymerase chain reaction can be produced on the basis of any of the nucleotide sequences shown in Appendix A. A nucleic acid of the invention may be amplified by means of cDNA or, alternatively, genomic DNA as template and suitable oligonucleotide primers according to PCR standard amplification techniques. The nucleic acid amplified in this way may be cloned into a suitable vector and characterized by DNA sequence analysis. Oligonucleotides corresponding to an MP nucleotide sequence may be prepared by standard syntheses using, for example, an automatic DNA synthesizer.

In a preferred embodiment, an isolated nucleic acid molecule of the invention comprises any of the nucleotide sequences listed in Appendix A.

In a further preferred embodiment, an isolated nucleic acid molecule of the invention comprises a nucleic acid molecule complementary to any of the nucleotide sequences shown in Appendix A or a section thereof, said nucleic acid molecule being sufficiently complementary to any of the nucleotide sequences shown in Appendix A for it to hybridize with any of the sequences indicated in Appendix A, resulting in a stable duplex.

In one embodiment, the nucleic acid molecule of the invention encodes a protein or a section thereof comprising an amino acid sequence which is sufficiently homologous to an amino acid sequence from Appendix B for the protein or a section thereof to be still capable of regulating a metabolic pathway in *C. glutamicum* transcriptionally, translationally or posttranslationally. The term "sufficiently homologous", as used herein, relates to proteins or sections thereof whose amino acid sequences have a minimum number of identical or equivalent amino acid residues (for example an amino acid residue having a side chain similar to that of an amino acid residue in any of the sequences from Appendix B) compared to an amino acid sequence from Appendix B so that the protein or a section thereof can transcriptionally, translationally or posttranslationally regulate a metabolic pathway in *C. glutamicum*. Protein components of these metabolic pathways, as described herein, may regulate the biosynthesis or degradation of one or more fine chemicals. Examples of these activities are likewise described herein. Thus the "function of an MP protein" relates to the overall regulation of one or more metabolic fine-chemical pathways. Table 1 lists examples of MP protein activities.

Sections of proteins encoded by the MP nucleic acid molecules of the invention are preferably biologically active sections of any of the MP proteins. The term "biologically active section of an MP protein", as used herein, is intended to comprise a section, for example a domain or a motive, of an MP protein, which can transcriptionally, translationally or posttranslationally regulate a metabolic pathway in *C. glutamicum* or has an activity indicated in Table 1. In order to determine whether an MP protein or a biologically active section thereof can regulate a metabolic pathway in *C. glutamicum* transcriptionally, translationally or posttranslationally, an enzyme activity assay may be carried out. These assay methods, as described in detail in Example 8 of the examples, are familiar to the skilled worker.

In addition to naturally occuring MP-sequence variants which may exist in the population, the skilled worker also understands that changes can be introduced into a nucleotide sequence from Appendix A via mutation, leading to a change in the amino acid sequence of the encoded MP protein, without impairing the functionality of the MP protein. Thus it is possible, for example, to prepare in a sequence from Appendix A nucleotide substitutions which lead to amino acid substitutions at "nonessential" amino acid residues. A "nonessential" amino acid residue in a wild-type sequence of any of the MP proteins (Appendix B) can be modified without modifying the activity of said MP protein, whereas an "essential" amino acid residue is required for MP-protein activity. However, other amino acid residues (for example nonconserved or merely semiconserved amino acid residues in the domain with MP activity) may be nonessential for activity and can therefore probably be modified without modifying the MP activity.

An isolated nucleic acid molecule encoding an MP protein which is homologous to a protein sequence from Appendix B may be generated by introducing one or more nucleotide substitutions, additions or deletions into a nucleotide sequence from Appendix A so that one or more amino acid substitutions, additions or deletions are introduced into the encoded protein. The mutations may be introduced into any of the sequences from Appendix A by standard techniques such as site-directed mutagenesis and PCR-mediated mutagenesis. Preference is given to introducing conservative amino acid substitutions at one or more of the predicted nonessential amino acid residues. A "conservative amino acid substitution" replaces the amino acid residue by an amino acid residue with a similar side chain. Families of amino acid residues with similar side chains have been defined in the art. These families comprise amino acids with basic side chains (e.g. lysine, arginine, histidine), acidic side chains (e.g. aspartic acid, glutamic acid), uncharged polar side chains (e.g. glycine, asparagine, glutamine, serine, threonine, tyrosine, cysteine), nonpolar side chains (e.g. alanine, valine, leucine, isoleucine, proline, phenylalanine, methionine, tryptophan), beta-branched side chains (e.g. threonine, valine, isoleucine) and aromatic side chains (e.g. tyrosine, phenylalanine, tryptophan, histidine). A predicted nonessential amino acid residue in an MP protein is thus preferably replaced by another amino acid residue of the same side-chain family. In another embodiment, the mutations may alternatively be introduced randomly over the entire or over part of the MP-encoding sequence, for example by saturation mutagenesis, and the resulting mutants may be tested for the MP activity described here in order to identify mutants maintaining MP activity. After mutagenesis of any of the sequences from Appendix A, the encoded protein may be expressed recombinantly, and the activity of said protein may be determined, for example, using the assays described herein (see Example 8 of the examples).

B. Recombinant Expression Vectors and Host Cells

Another aspect of the invention relates to vectors, preferably expression vectors, containing a nucleic acid which encodes an MP protein (or a section thereof). The term "vector", as used herein, relates to a nucleic acid molecule capable of transporting another nucleic acid to which it is bound. One type of vector is a "plasmid" which term means a circular double-stranded DNA loop into which additional DNA segments can be ligated. Another type of vector is a viral vector, in the case of which additional DNA segments can be ligated into the viral genome. Certain vectors are capable of replicating autonomously in a host cell into which they have been introduced (for example bacterial vectors with bacterial origin of replication and episomal mammalian vectors). Other vectors (e.g. nonepisomal mammalian vectors) are integrated into the genome of a host cell when introduced into said host cell and thereby replicated together with the host genome. Moreover, particular vectors are capable of controlling the expression of genes to which they are functionally linked. These vectors are referred to as "expression vectors". Normally, expression vectors used in DNA recombination techniques are in the form of plasmids. In the present description, "plasmid" and "vector" may be used interchangeably, since the plasmid is the most commonly used type of vector. The invention is intended to comprise said other types of expression vectors such as viral vectors (for example, replication-deficient retroviruses, adenoviruses and adenovirus-related viruses), which exert similar functions.

The recombinant expression vector of the invention comprises a nucleic acid of the invention in a form which is suitable for expressing said nucleic acid in a host cell, meaning that the recombinant expression vectors comprise one or more regulatory sequences which are selected on the basis of the host cells to be used for expression and which are functionally linked to the nucleic acid sequence to be expressed. In a recombinant expression vector, the term "functionally linked" means that the nucleotide sequence of interest is bound to the regulatory sequence(s) such that expression of said nucleotide sequence is possible (for example in an in vitro transcription/translation system or in any host cell, if the vector has been introduced into said host cell). The term "regulatory sequence" is intended to comprise promoters, enhancers and other expression control elements (e.g. polyadenylation signals). These regulatory sequences are described, for example, in Goeddel: Gene Expression Technology: Methods in Enzymology 185, Academic Press, San Diego, Calif. (1990). Regulatory sequences comprise those which control constitutive expression of a nucleotide sequence in many types of host cells and those which control direct expression of the nucleotide sequence only in particular host cells. The skilled worker understands that designing an expression vector may depend on factors such as the choice of host cell to be transformed, the extent of expression of the protein of interest, etc. The expression vectors of the invention may be introduced into the host cells in order to prepare proteins or peptides, including fusion proteins or fusion peptides, which are encoded by the nucleic acids as described herein (e.g. MP proteins, mutated forms of MP proteins, fusion proteins, etc.).

The recombinant expression vectors of the invention may be designed for expressing MP proteins in prokaryotic or eukaryotic cells. For example, MP genes may be expressed in bacterial cells such as *C. glutamicum*, insect cells (using Baculovirus expression vectors), yeast cells and other fungal cells (see Romanos, M. A. et al. (1992) "Foreign gene expression in yeast: a review", Yeast 8: 423–488; van den Hondel, C. A. M. J. J. et al. (1991) "Heterologous gene expression in filamentous fungi" in: More Gene Manipulations in Fungi, J. W. Bennet & L. L. Lasure, editors, pp. 396–428: Academic Press: San Diego; and van den Hondel, C. A. M. J. J. & Punt, P. J. (1991) "Gene transfer systems and vector development for filamentous fungi" in: Applied Molecular Genetics of Fungi, Peberdy, J. F. et al., editors, pp. 1–28, Cambridge University Press: Cambridge), algal and multicellular plant cells (see Schmidt, R. and Willmitzer, L. (1988) "High efficiency *Agrobacterium tumefaciens*-mediated transformation of *Arabidopsis thaliana* leaf and cotyledon explants" Plant Cell Rep.: 583–586) or mammalian cells. Suitable host cells are further discussed in Goeddel, Gene Expression Technology: Methods in Enzymology 185, Academic Press, San Diego, Calif. (1990). Alternatively, the recombinant expression vector may be transcribed and translated in vitro, for example by using T7 promoter regulatory sequences and T7 polymerase.

Proteins are expressed in prokaryotes mainly by using vectors containing constitutive or inducible promoters which control the expression of fusion or nonfusion proteins. Fusion vectors contribute a number of amino acids to a protein encoded therein, usually at the amino terminus of the recombinant protein. These fusion vectors usually have three tasks: 1) enhancing the expression of recombinant protein; 2) increasing the solubility of the recombinant protein; and 3) supporting the purification of the recombinant protein by acting as a ligand in affinity purification. Often a proteolytic cleavage site is introduced into fusion expression vectors at the junction of fusion unit and recombinant protein so that the recombinant protein can be separated from the fusion unit after purifying the fusion protein. These enzymes and their corresponding recognition sequences comprise factor Xa, thrombin and enterokinase.

Common fusion expression vectors comprise PGEX (Pharmacia Biotech Inc; Smith, D. B. and Johnson, K. S. (1988) Gene 67: 31–40), pMAL (New England Biolabs, Beverly, Mass.) and pRIT 5 (Pharmacia, Piscataway, N.J.), in which glutathione S-transferase (GST), maltose E-binding protein and protein A, respectively, are fused to the recombinant target protein. In one embodiment, the coding sequence of the MP protein is cloned into a pGEX expression vector such that a vector is generated, which encodes a fusion protein comprising, from N terminus to C terminus, GST—thrombin cleavage site—protein X. The fusion protein may be purified via affinity chromatography by means of a glutathione-agarose resin. The recombinant MP protein which is not fused to GST may be obtained by cleaving the fusion protein with thrombin.

Examples of suitable inducible nonfusion E. coli expression vectors include pTrc (Amann et al., (1988) Gene 69: 301–315) and pET 11d (Studier et al. Gene Expression Technology: Methods in Enzymology 185, Academic Press, San Diego, Calif. (1990) 60–89). The target gene expression from the pTrc vector is based on transcription from a hybrid trp-lac fusion promoter by host RNA polymerase. The target gene expression from the pET11d vector is based on transcription from a T7-gn10-lac fusion promoter, which is mediated by a coexpressed viral RNA polymerase (T7 gn1). This viral polymerase is provided by the BL 21 (DE3) or HMS174 (DE3) host strain by a resident λ prophage which harbors a T7 gn1 gene under the transcriptional control of the lacUV 5 promoter.

One strategy for maximizing expression of the recombinant protein is to express said protein in a host bacterium whose ability to proteolytically cleave said recombinant protein is disrupted (Gottesman, S. Gene Expression Technology: Methods in Enzymology 185, Academic Press, San Diego, Calif. (1990) 119–128). Another strategy is to modify the nucleic acid sequence of the nucleic acid to be inserted into an expression vector such that the individual codons for each amino acid are those which are preferably used in a bacterium selected for expression, such as C. glutamicum (Wada et al. (1992) Nucleic Acids Res. 20: 2111–2118). This modification of the nucleic acid sequences of the invention is carried out by standard techniques of DNA synthesis.

In a further embodiment, the MP-protein expression vector is an expression vector of yeast. Examples of vectors for expression in the yeast S. cerevisiae include pYepSec1 (Baldari et al., (1987) Embo J. 6: 229–234), pMFa (Kurjan and Herskowitz (1982) Cell 30: 933–943), pJRY88 (Schultz et al. (1987) Gene 54: 113–123) and pYES2 (Invitrogen Corporation, San Diego, Calif.). Vectors and methods for constructing vectors which are suitable for use in other fungi such as filamentous fungi include those which are described in detail in: van den Hondel, C. A. M. J. J. & Punt, P. J. (1991) "Gene transfer systems and vector development for filamentous fungi", in: Applied Molecular Genetics of fungi, J. F. Peberdy et al., editors, pp. 1–28, Cambridge University Press: Cambridge.

As an alternative, it is possible to express the MP proteins of the invention in insect cells using Baculovirus expression vectors. Baculovirus vectors available for the expression of proteins in cultured insect cells (e.g. Sf9 cells) include the pAc series (Smith et al., (1983) Mol. Cell Biol. 3: 2156–2165) and the pVL series (Lucklow and Summers (1989) Virology 170: 31–39).

In a further embodiment, the MP proteins of the invention may be expressed in unicellular plant cells (such as algae) or in plant cells of higher plants (e.g. spermatophytes such as crops). Examples of expression vectors of plants include those which are described in detail in Becker, D., Kemper, E., Schell, J. and Masterson, R. (1992) "New plant binary vectors with selectable markers located proximal to the left border", Plant Mol. Biol. 20: 1195–1197; and Bevan, M. W. (1984) "Binary Agrobacterium vectors for plant transformation", Nucl. Acids Res. 12: 8711–8721.

In another embodiment, a nucleic acid of the invention is expressed in mammalian cells using a mammalian expression vector. Examples of mammalian expression vectors include pCDM8 (Seed, B. (1987) Nature 329:840) and pMT2PC (Kaufman et al. (1987) EMBO J. 6: 187–195). When used in mammalian cells, the control functions of the expression vector are often provided by viral regulatory elements. Commonly used promoters are derived, for example, from polyoma, adenovirus2, cytomegalovirus and Simian virus 40. Other suitable expression systems for prokaryotic and eukaryotic cells can be found in Chapters 16 and 17 of Sambrook, J., Fritsch, E. F. and Maniatis, T., Molecular cloning: A Laboratory Manual, 2nd edition, Cold Spring Harbor Laboratory, Cold Spring Harbor Laboratory Press, Cold Spring Harbor, N.Y., 1989.

In a further embodiment, the recombinant mammalian expression vector may cause expression of the nucleic acid, preferably in a particular cell type (for example, tissue-specific regulatory elements are used for expressing the nucleic acid). Tissue-specific regulatory elements are known in the art. Nonlimiting examples of suitable tissue-specific promoters include the albumin promoter (liver-specific; Pinkert et al. (1987) Genes Dev. 1: 268–277), lymphoid-specific promoters (Calame and Eaton (1988) Adv. Immunol. 43: 235–275), in particular promoters of T-cell receptors (Winoto and Baltimore (1989) EMBO J. 8: 729–733) and immunoglobulins (Banerji et al. (1983) Cell 33: 729–740; Queen and Baltimore (1983) Cell 33: 741–748), neuron-specific promoters (e.g. neurofilament promoter; Byrne and Ruddle (1989) PNAS 86: 5473–5477), pancreas-specific promoters (Edlund et al., (1985) Science 230: 912–916) and mamma-specific promoters (e.g. milk serum promoter; U.S. Pat. No. 4,873,316 and European Patent Application document No. 264 166). Development-regulated promoters, for example the murine hox promoters (Kessel and Gruss (1990) Science 249: 374–379) and the α-fetoprotein promoter (Campes and Tilghman (1989) Genes Dev. 3: 537–546), are likewise included.

In addition, the invention provides a recombinant expression vector comprising an inventive DNA molecule which has been cloned into the expression vector in antisense direction. This means that the DNA molecule is functionally linked to a regulatory sequence such that an RNA molecule which is antisense to MP-mRNA can be expressed (via transcription of the DNA molecule). It is possible to select regulatory sequences which are functionally bound to a nucleic acid cloned in antisense direction and which control the continuous expression of the antisense-RNA molecule in a multiplicity of cell types; for example, it is possible to select viral promoters and/or enhancers or regulatory sequences which control the constitutive tissue-specific or cell type-specific expression of antisense RNA. The antisense expression vector may be in the form of a recombinant plasmid, phagemid or attenuated virus, which produces antisense nucleic acids under the control of a highly effective regulatory region whose activity is determined by the cell type into which the vector is introduced. The regulation of gene expression by means of antisense genes is discussed in Weintraub, H. et al., Antisense-RNA as a molecular tool for genetic analysis, Reviews—Trends in Genetics, Vol. 1(1) 1986.

Another aspect of the invention relates to the host cells into which a recombinant expression vector of the invention has been introduced. The terms "host cell" and "recombinant host cell" are used interchangeably herein. Naturally, these terms relate not only to a particular target cell but also to the progeny or potential progeny of this cell. Since particular modifications may appear in successive generations, due to mutation or environmental factors, this progeny is not necessarily identical with the parental cell but is still included in the scope of the term as used herein.

A host cell may be a prokaryotic or eukaryotic cell. For example, an MP protein may be expressed in bacterial cells such as *C. glutamicum*, insect cells, yeast or mammalian cells (such as Chinese hamster ovary (CHO) cells or COS cells). Other suitable host cells are familiar to the skilled worker. Microorganisms which are related to *Corynebacterium glutamicum* and can be used in a suitable manner as host cells for the nucleic acid and protein molecules of the invention are listed in Table 3.

Conventional transformation or transfection methods can be used to introduce vector DNA into prokaryotic or eukaryotic cells. The terms "transformation" and "transfection", as used herein, are intended to comprise a multiplicity of methods known in the art for introducing foreign nucleic acid (e.g. DNA) into a host cell, including calcium phosphate or calcium chloride coprecipitation, DEAE-dextran-mediated transfection, lipofection or electroporation. Suitable methods for transformation or transfection of host cells can be found in Sambrook et al. (Molecular Cloning: A Laboratory Manual. 2nd edition Cold Spring Harbor Laboratory, Cold Spring Harbor Laboratory Press, Cold Spring Harbor, N.Y., 1989) and other laboratory manuals.

In the case of stable transfection of mammalian cells, it is known that, depending on the expression vector used and transfection technique used, only a small proportion of the cells integrate the foreign DNA into their genome. These integrants are usually identified and selected by introducing a gene which encodes a selectable marker (e.g. resistance to antibiotics) together with the gene of interest into the host cells. Preferred selectable markers include those which impart resistance to drugs such as G418, hygromycin and methotrexate. A nucleic acid which encodes a selectable marker may be introduced into a host cell on the same vector that encodes an MP protein or may be introduced on a separate vector. Cells which have been stably transfected with the introduced nucleic acid may be identified by drug selection (for example, cells which have integrated the selectable marker survive, whereas the other cells die).

A homologously recombined microorganism is generated by preparing a vector which contains at least one MP-gene section into which a deletion, addition or substitution has been introduced in order to modify or functionally disrupt the MP gene. Said MP gene is preferably a *Corynebacterium glutamicum* MP gene, but it is also possible to use a homolog from a related bacterium or even from a mammalian, yeast or insect source. In a preferred embodiment, the vector is designed such that homologous recombination functionally disrupts the endogenous MP gene (i.e. the gene no longer encodes a functional protein; likewise referred to as "knockout" vector). As an alternative, the vector may be designed such that homologous recombination mutates or otherwise modifies the endogenous MP gene which, however, still encodes the functional protein (for example, the regulatory region located upstream may be modified such that thereby the expression of the endogenous MP protein is modified.). The modified MP-gene section in the homologous recombination vector is flanked at its 5' and 3' ends by additional nucleic acid of the MP gene, which makes possible a homologous recombination between the exogenous MP gene carried by the vector and an endogenous MP gene in a microorganism. The length of the additional flanking MP nucleic acid is sufficient for a successful homologous recombination with the endogenous gene. Usually, the vector contains several kilobases of flanking DNA (both at the 5' and the 3' ends) (see, for example, Thomas, K. R. and Capecchi, M. R. (1987) Cell 51: 503 for a description of homologous recombination vectors). The vector is introduced into a microorganism (e.g. by electroporation) and cells in which the introduced MP gene has homologously recombined with the endogenous MP gene are selected using methods known in the art.

In another embodiment, it is possible to produce recombinant microorganisms which contain selected systems which make possible a regulated expression of the introduced gene. The insertion of an MP gene under the control of the lac operon in a vector enables, for example, MP-gene expression only in the presence of IPTG. These regulatory systems are known in the art.

A host cell of the invention, such as a prokaryotic or eukaryotic host cell in culture, may be used for producing (i.e. expressing) an MP protein. In addition, the invention provides methods for producing MP proteins by using the host cells of the invention. In one embodiment, the method comprises the cultivation of the host cell of the invention (into which a recombinant expression vector encoding an MP protein has been introduced or in whose genome a gene encoding a wild-type or modified MP protein has been introduced) in a suitable medium until the MP protein has been produced. In a further embodiment, the method comprises isolating the MP proteins from the medium or the host cell.

C. Uses and Methods of the Invention

The nucleic acid molecules, proteins, protein homologs, fusion proteins, primers, vectors and host cells described herein may be used in one or more of the following methods: identification of *C. glutamicum* and related organisms, mapping of genomes of organisms related to *C. glutamicum*, identification and localization of *C. glutamicum* sequences of interest, evolutionary studies, determination of MP-protein regions required for function, modulation of the activity of an MP protein; modulation of the activity of an MP pathway; and modulation-of the cellular production of a compound of interest, such as a fine chemical. The MP nucleic acid molecules of the invention have a multiplicity of uses. First, they may be used for identifying an organism as *Corynebacterium glutamicum* or close relatives thereof. They may also be used for identifying *C. glutamicum* or a relative thereof in a mixed population of microorganisms. The invention provides the nucleic acid sequences of a number of *C. glutamicum* genes. Probing the extracted genomic DNA of a culture of a uniform or mixed population of microorganisms under stringent conditions with a probe which comprises a region of a *C. glutamicum* gene which is unique in this organism makes it possible to determine whether said organism is present. Although *Corynebacterium glutamicum* itself is nonpathogenic, it is related to pathogenic species such as *Corynebacterium diptheriae*. The detection of such an organism is of substantial clinical importance.

The nucleic acid and protein molecules of the invention may serve as markers for specific regions of the genome. This is useful not only for mapping the genome but also for functional studies of *C. glutamicum* proteins. The genomic region to which a particular *C. glutamicum* DNA-binding protein binds may be identified, for example, by cleaving the *C. glutamicum* genome and incubating the fragments with the DNA-binding protein. Those fragments which bind the protein may additionally be probed with the nucleic acid molecules of the invention, preferably by using readily detectable labels; binding of such a nucleic acid molecule to the genomic fragment makes it possible to locate the fragment on the map of the *C. glutamicum* genome, and carrying out this process several times using different enzymes facilitates rapid determination of the nucleic acid sequence to which the protein binds. Moreover, the nucleic acid molecules of the invention may be sufficiently homologous to the sequences of related species for these nucleic acid molecules to serve as markers for constructing a genomic map in related bacteria such as *Brevibacterium lactofermentum*.

The MP nucleic acid molecules of the invention are likewise suitable for evolutionary studies and protein structure studies. Many prokaryotic and eukaryotic cells utilize the metabolic processes in which the molecules of the invention are involved; by comparing the sequences of the nucleic acid molecules of the invention with those sequences which encode similar enzymes from other organisms, it is possible to determine the degree of evolutionary relationship of said organisms. Accordingly, such a comparison makes it possible to determine which sequence regions are conserved and which are not, and this may be helpful in determining those regions of the protein, which are essential for enzyme function. This type of determination is valuable for protein engineering studies and may give an indication as to which protein can tolerate mutagenesis without losing its function.

Manipulation of the MP nucleic acid molecules of the invention may cause the production of MP proteins with functional differences to wild-type MP proteins. These proteins can be improved with respect to their efficiency or activity, can be present in the cell in larger amounts than normal or can be weakened with respect to their efficiency or activity.

These changes in activity may be such that the yield, production and/or efficiency of production of one or more fine chemicals from *C. glutamicum* are improved. By optimizing the activity of an MP protein which activates transcription or translation of a gene encoding a protein of the biosynthesis of a fine chemical of interest or by influencing or deleting the activity of an MP protein which represses transcription or translation of such a gene, it is possible to increase the activity or activity rate of this biosynthetic pathway, owing to the presence of increased amounts of, for example, a limiting enzyme. Correspondingly, it is possible, by modifying the activity of an MP protein such that it constitutively inactivates posttranslationally a protein which is involved in the degradation pathway of a fine chemical of interest or by modifying the activity of an MP protein such that it constitutively represses transcription or translation of such a gene, to increase the yield and/or production rate of said fine chemical from the cell, owing to the reduced degradation of the compound.

Modulating the activity of one or more MP proteins makes it possible to indirectly stimulate the production or to improve the production rate of one or more fine chemicals from the cell, owing to the linkage of various metabolic pathways. It is possible, for example, by increasing the yield, production and/or efficiency of production by activating the expression of one or more enzymes in lysine biosynthesis, to increase simultaneously the expression of other compounds such as other amino acids which the cell usually needs in larger quantities when larger quantities of lysine are required. It is also possible to modify the metabolic regulation through in the entire cell such that the cell under the environmental conditions of a fermentation culture (in which the supply of nutrients and oxygen may be poor and possibly toxic waste products may be present in large quantities in the environment) and may have improved growth or replication. Thus it is possible, for example, to improve the growth and propagation of the cells in culture, even if the growth conditions are suboptimal, by mutagenizing an MP protein which suppresses the synthesis of molecules required for cell membrane production in reaction to high levels of waste products in the extracellular medium (in order to block cell growth and cell division in suboptimal growth conditions) such that said protein is no longer capable of repressing said synthesis. Such increased growth or such increased viability should likewise increase the yields and/or production rate of a fine chemical of interest from a fermentative culture, owing to the relatively large number of cells producing this compound in the culture.

The abovementioned strategies for the mutagenesis of MP proteins, which ought to increase the yields of a fine chemical of interest in *C. glutamicum* are not intended to be limiting; variations of these strategies are quite obvious to the skilled worker. These strategies and the mechanisms disclosed herein make it possible to use the nucleic acid and protein molecules of the invention in order to generate *C. glutamicum* or related bacterial strains expressing mutated MP nucleic acid and protein molecules so as to improve the yield, production and/or efficiency of production of a compound of interest. The compound of interest may be a natural *C. glutamicum* product which comprises the end products of the biosynthetic pathways and intermediates of naturally occuring metabolic pathways and also molecules which do not naturally occur in the *C. glutamicum* metabolism but are produced by a *C. glutamicum* strain of the invention.

The following examples which are not to be understood as being limiting further illustrate the present invention. The contents of all references, patent applications, patents and published patent applications cited in this patent application are hereby incorporated by way of reference.

EXAMPLES

Example 1

Preparation of Total Genomic DNA from *Corynebacterium glutamicum* ATCC13032

A *Corynebacterium glutamicum* (ATCC 13032) culture was cultivated with vigorous shaking in BHI medium (Difco) at 30° C. overnight. The cells were harvested by centrifugation, the supernatant was discarded and the cells were resuspended in 5 ml of buffer I (5% of the original culture volume—all volumes stated have been calculated for a culture volume of 100 ml). Composition of buffer I: 140.34 g/l sucrose, 2.46 g/l $MgSO_4.7\ H_2O$, 10 ml/l $KH_2PO_4$ solution (100 g/l, adjusted to pH 6.7 with KOH), 50 ml/l M12 concentrate (10 g/l $(NH_4)_2SO_4$, 1 g/l NaCl, 2 g/l $MgSO_4.7\ H_2O$, 0.2 g/l $CaCl_2$, 0.5 g/l yeast extract (Difco), 10 ml/l trace element mixture (200 mg/l $FeSO_4.H_2O$, 10 mg/l $ZnSO_4.7\ H_2O$, 3 mg/l $MnCl_2.4\ H_2O$, 30 mg/l $H_3BO_3$, 20 mg/l $CoCl_2.6\ H_2O$, 1 mg/l $NiCl_2.6\ H_2O$, 3 mg/l $Na_2MoO_4.2\ H_2O$), 500 mg/l complexing agents (EDTA or citric acid), 100 ml/l vitamin mixture (0.2 ml/l biotin, 0.2 mg/l folic acid, 20 mg/l p-aminobenzoic acid, 20 mg/l riboflavin, 40 mg/l Ca pantothenate, 140 mg/l nicotinic acid, 40 mg/l pyridoxol hydrochloride, 200 mg/l myoinositol). Lysozyme was added to the suspension at a final concentration of 2.5 mg/ml. After incubation at 37° C. for approx. 4 h, the cell wall was degraded and the protoplasts obtained were harvested by centrifugation. The pellet was washed once with 5 ml of buffer I and once with 5 ml of TE buffer (10 mM Tris-HCl, 1 mM EDTA, pH 8). The pellet was resuspended in 4 ml of TE buffer and 0.5 ml of SDS solution (10%) and 0.5 ml of NaCl solution (5 M) were added. After addition of proteinase K at a final concentration of 200 μg/ml, the suspension was incubated at 37° C. for approx. 18 h. The DNA was purified via extraction with phenol, phenol/chloroform/ isoamyl alcohol and chloroform/isoamyl alcohol by means of standard methods. The DNA was then precipitated by addition of 1/50 volume of 3 M sodium acetate and 2 volumes of ethanol, subsequent incubation at −20° C. for 30 min and centrifugation at 12 000 rpm in a high-speed centrifuge using an SS34 rotor (Sorvall) for 30 min. The DNA was dissolved in 1 ml of TE buffer containing 20 µg/ml RNase A and dialyzed against 1000 ml of TE buffer at 4° C. for at least 3 h. The buffer was exchanged 3 times during this period. 0.4 ml of 2 M LiCl and 0.8 ml of ethanol were added to 0.4 ml aliquots of the dialyzed DNA solution. After incubation at −20° C. for 30 min, the DNA was collected by centrifugation (13 000 rpm, Biofuge Fresco, Heraeus, Hanau, Germany). The DNA pellet was dissolved in TE buffer. It was possible to use DNA prepared by this method for all purposes, including Southern blotting and constructing genomic libraries.

Example 2

Construction of Genomic *Corynebacterium glutamicum* (ATCC13032) Banks in *Escherichia coli*

Starting from DNA prepared as described in Example 1, cosmid and plasmid banks were prepared according to known and well-established methods (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

It was possible to use any plasmid or cosmid. Particular preference was given to using the plasmids pBR322 (Sutcliffe, J. G. (1979) Proc. Natl Acad. Sci. USA, 75: 3737–3741); pACYC177 (Change & Cohen (1978) J. Bacteriol. 134: 1141–1156); pBS series plasmids (pBSSK+, pBSSK− and others; Stratagene, La Jolla, USA) or cosmids such as SuperCos1 (Stratagene, La Jolla, USA) or Lorist6 (Gibson, T. J. Rosenthal, A., and Waterson, R. H. (1987) Gene 53: 283–286).

Example 3

DNA Sequencing and Functional Computer Analysis

Genomic banks, as described in Example 2, were used for DNA sequencing according to standard methods, in particular the chain termination method using ABI377 sequencers (see, for example, Fleischman, R. D. et al. (1995) "Whole-genome Random Sequencing and Assembly of *Haemophilus Influenzae* Rd.", Science 269; 496–512). Sequencing primers having the following nucleotide sequences were used: 5'-GGAAACAGTATGACCATG-3' oder 5'-GTAAAAC-GACGGCCAGT-3'.

Example 4

In Vivo Mutagenesis

In vivo mutagenesis of *Corynebacterium glutamicum* may be carried out by passing a plasmid (or other vector) DNA through *E. coli* or other microorganisms (e.g. *Bacillus* spp. or yeasts such as *Saccharomyces cerevisiae*) which cannot maintain the integrity of their genetic information. Common mutator strains contain mutations in the genes for the DNA repair system (e.g., mutHLS, mutD, mutT, etc., for comparison see Rupp, W. D. (1996) DNA repair mechanisms in *Escherichia coli* and *Salmonella*, pp. 2277–2294, ASM: Washington). These strains are known to the skilled worker. The use of these strains is illustrated, for example, in Greener, A. and Callahan, M. (1994) Strategies 7; 32–34.

Example 5

DNA Transfer Between *Escherichia coli* and *Corynebacterium glutamicum*

A plurality of *Corynebacterium* and *Brevibacterium* species contain endogenous plasmids (such as, for example, pHM1519 or pBL1) which replicate autonomously (for a review see, for example, Martin, J. F. et al. (1987) Biotechnology 5: 137–146). Shuttle vectors for *Escherichia coli* and *Corynebacterium glutamicum* can be constructed readily by means of standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons), to which an origin of replication for and a suitable marker from *Corynebacterium glutamicum* are added. Such origins of replication are preferably taken from endogenous plasmids which have been isolated from *Corynebacterium* and *Brevibacterium* species. Particular use as transformation markers for these species are genes for kanamycin resistance (such as those derived from the Tn5 or the Tn903 transposon) or for chloramphenicol (Winnacker, E. L. (1987) "From Genes to Clones—Introduction to Gene Technology", VCH, Weinheim). There are numerous examples in the literature for preparing a large multiplicity of shuttle vectors which are replicated in *E. coli* and *C. glutamicum* and which can be used for various purposes, including the overexpression of genes (see, for example, Yoshihama, M. et al. (1985) J. Bacteriol. 162: 591–597, Martin, J. F. et al., (1987) Biotechnology, 5: 137–146 and Eikmanns, B. J. et al. (1992) Gene 102: 93–98).

Standard methods make it possible to clone a gene of interest into one of the above-described shuttle vectors and to introduce such hybrid vectors into *Corynebacterium glutamicum* strains. *C. glutamicum* can be transformed via protoplast transformation (Kastsumata, R. et al., (1984) J. Bacteriol. 159, 306–311), electroporation (Liebl, E. et al., (1989) FEMS Microbiol. Letters, 53: 399–303) and, in cases in which specific vectors are used, also via conjugation (as described, for example, in Schafer, A., et al. (1990) J. Bacteriol. 172: 1663–1666). Likewise, it is possible to transfer the shuttle vectors for *C. glutamicum* to *E. coli* by preparing plasmid DNA from *C. glutamicum* (by means of standard methods known in the art) and transforming it into *E. coli*. This transformation step can be carried out using standard methods but advantageously preferably an Mcr-deficient *E. coli* strain such as NM522 (Gough & Murray (1983) J. Mol. Biol. 166: 1–19) is used.

Example 6

Determination of the Expression of the Mutated Protein

The observations of the activity of a mutated protein in a transformed host cell are based on the fact that the mutated protein is expressed in a similar manner and in similar quantity to the wild-type protein. A suitable method for determining the amount of transcription of the mutated gene (an indication of the amount of mRNA available for translation of the gene product) is to carry out a Northern blot (see, for example, Ausubel et al., (1988) Current Protocols in Molecular Biology, Wiley: New York), with a primer which is designed such that it binds to the gene of interest being provided with a detectable (usually radioactive or chemiluminescent) label such that—when the total RNA of a culture of the organism is extracted, fractionated on a gel, transferred to a stable matrix and incubated with this probe—binding and binding quantity of the probe indicate the presence and also the amount of mRNA for said gene. This information is an indicator of the extent to which the mutated gene has been transcribed. Total cell RNA can be isolated from *Corynebacterium glutamicum* by various methods known in the art, as described in Bormann, E. R. et al., (1992) Mol. Microbiol. 6: 317–326.

The presence or the relative amount of protein translated from said mRNA can be determined by using standard techniques such as Western blot (see, for example, Ausubel et al. (1988) "Current Protocols in Molecular Biology", Wiley, New York). In this method, total cell proteins are extracted, separated by gel electrophoresis, transferred to a matrix such as nitrocellulose and incubated with a probe, for example an antibody, which binds specifically to the protein of interest. This probe is usually provided with a chemiluminescent or calorimetric label which can be readily detected. The presence and the observed amount of label indicate the presence and the amount of the desired mutant protein in the cell.

Example 7

Growth of Genetically Modified *Corynebacterium glutamicum*—Media and Cultivation Conditions Genetically modified corynebacteria are cultivated in synthetic or natural growth media. A number of different growth media for corynebacteria are known and readily available (Lieb et al. (1989) Appl. Microbiol. Biotechnol. 32: 205–210; von der Osten et al. (1998) Biotechnology Letters 11: 11–16; Patent DE 4 120 867; Liebl (1992) "The Genus *Corynebacterium*", in: The Procaryotes, Vol. II, Balows, A., et al., editors Springer-Verlag). These media are composed of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch and cellulose. Sugars may also be added to the media via complex compounds such as molasses or other byproducts from sugar refining. It may also be advantageous to add mixtures of various carbon sources. Other possible carbon sources are alcohols and organic acids, such as methanol, ethanol, acetic acid or lactic acid. Nitrogen sources are usually organic or inorganic nitrogen compounds or materials containing these compounds. Examples of nitrogen sources include ammonia gas and ammonium salts such as $NH_4Cl$ or $(NH_4)_2SO_4$, $NH_4OH$, nitrates, urea, amino acids and complex nitrogen sources such as corn steep liquor, soya meal, soya protein, yeast extracts, meat extracts and others.

Inorganic salt compounds which may be present in the media include the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechuate and organic acids such as citric acid. The media usually also contain other growth factors such as vitamins or growth promoters, examples of which include biotin, riboflavin, thiamine, folic acid, nicotinic acid, pantothenate and pyridoxine. Growth factors and salts are frequently derived from complex media components such as yeast extract, molasses, corn steep liquor and the like. The exact composition of the media heavily depends on the particular experiment and is decided upon individually for each case. Information on the optimization of media can be found in the textbook "Applied Microbiol. Physiology, A Practical Approach" (editors P. M. Rhodes, P. F. Stanbury, IRL Press (1997) pp. 53–73, ISBN 0 19 963577 3). Growth media can also be obtained from commercial suppliers, for example Standard 1 (Merck) or BHI (brain heart infusion, DIFCO) and the like.

All media components are sterilized, either by heat (20 min at 1.5 bar and 121° C.) or by sterile filtration. The components may be sterilized either together or, if required, separately. All media components may be present at the start of the cultivation or added continuously or batchwise, as desired.

The cultivation conditions are defined separately for each experiment. The temperature should be between 15° C. and 45° C. and may be kept constant or may be altered during the experiment. The pH of the medium should be in the range from 5 to 8.5, preferably around 7.0 and may be maintained by adding buffers to the media. An example of a buffer for this purpose is a potassium phosphate buffer. Synthetic buffers such as MOPS, HEPES, ACES, etc. may be used alternatively or simultaneously. Addition of NaOH or $NH_4OH$ can also keep the pH constant during cultivation. If complex media components such as yeast extract are used, the demand for additional buffers decreases, since many complex compounds have a high buffer capacity. In the case of using a fermenter for cultivating microorganisms, the pH may also be regulated using gaseous ammonia.

The incubation period is usually in a range from several hours to several days. This time is selected such that the maximum amount of product accumulates in the broth. The growth experiments disclosed may be carried out in a multiplicity of containers such as microtiter plates, glass tubes, glass flasks or glass or metal fermenters of different sizes. For the screening of a large number of clones, the microorganisms should be grown in microtiter plates, glass tubes or shaker flasks either with or without baffles. Preference is given to using 100 ml shaker flasks which are filled with 10% (based on volume) of the required growth medium. The flasks should be shaken on an orbital shaker (amplitude 25 mm) at a speed in the range of 100–300 rpm. Losses due to evaporation can be reduced by maintaining a humid atmosphere; alternatively, the losses due to evaporation should be corrected mathematically.

If genetically modified clones are investigated, an unmodified control clone or a control clone containing the basic plasmid without insert should also be assayed. The medium is inoculated to an $OD_{600}$ of 0.5–1.5, with cells being used which have been grown on agar plates such as CM plates (10 g/l glucose, 2.5 g/l NaCl, 2 g/l urea, 10 g/l polypeptone, 5 g/l yeast extract, 5 g/l meat extract, 22 g/l agar pH 6.8 with 2 M NaOH) which have been incubated at 30° C. The media are inoculated either by introducing a saline solution of *C. glutamicum* cells from CM plates or by adding a liquid preculture of said bacterium.

Example 8

In Vitro Analysis of the Function of Mutated Proteins

The determination of the activities and kinetics of enzymes is well known in the art. Experiments for determining the activity of a particular modified enzyme must be adapted to the specific activity of the wild-type enzyme, and this is within the capabilities of the skilled worker. Overviews regarding enzymes in general and also specific details concerning the structure, kinetics, principles, methods, applications and examples of the determination of many enzyme activities can be found, for example, in the following references: Dixon, M., and Webb, E. C: (1979) Enzymes, Longmans, London; Fersht (1985) Enzyme Structure and Mechanism, Freeman, New York; Walsh (1979) Enzymatic Reaction Mechanisms. Freeman, San Francisco; Price, N. C., Stevens, L. (1982) Fundamentals of Enzymology. Oxford Univ. Press: Oxford; Boyer, P. D: editors (1983) The Enzymes, 3rd edition, Academic Press, New York; Bisswanger, H. (1994) Enzymkinetik, 2nd edition VCH, Weinheim (ISBN 3527300325); Bergmeyer, H. U., Bergmeyer, J., Graβl, M. editors (1983–1986) Methods of Enzymatic Analysis, 3rd edition, Vol. I–XII, Verlag Chemie: Weinheim; and Ullmann's Encyclopedia of Industrial Chemistry (1987) Vol. A9, "Enzymes", VCH, Weinheim, pp. 352–363.

The activities of proteins binding to DNA can be measured by many well-established methods such as DNA bandshift assays (which are also referred to as gel retardation assays). The action of these proteins on the expression of other molecules can be measured using reporter gene assays (as described in Kolmar, H. et al., (1995) EMBO J. 14: 3895–3904 and in references therein). Reporter gene assay systems are well known and established for applications in prokaryotic and eukaryotic cells, with enzymes such as beta-galactosidase, green fluorescent protein and several other enzymes being used.

The activity of membrane transport proteins can be determined according to the techniques described in Gennis, R. B. (1989) "Pores, Channels and Transporters", in Biomembranes, Molecular Structure and Function, Springer: Heidelberg, pp. 85–137; 199–234; and 270–322.

Example 9

Analysis of the Influence of Mutated Protein on the Production of the Product of Interest The effect of the genetic modification in *C. glutamicum* on the production of a compound of interest (such as an amino acid) can be determined by growing the modified microorganisms under suitable conditions (such as those described above) and testing the medium and/or the cellular components for increased production of the product of interest (i.e. an amino acid). Such analytical techniques are well known to the skilled worker and include spectroscopy, thin-layer chromatography, various types of coloring methods, enzymic and microbiological methods and analytical chromatography such as high performance liquid chromatography (see, for example, Ullman, Encyclopedia of Industrial Chemistry, Vol. A2, pp. 89–90 and pp. 443–613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp. 469–714, VCH: Weinheim; Belter, P. A. et al. (1988) Bioseparations: downstream processing for Biotechnology, John Wiley and Sons; Kennedy, J. F. and Cabral, J. M. S. (1992) Recovery processes for biological Materials, John Wiley and Sons; Shaeiwitz, J. A. and Henry, J. D. (1988) Biochemical Separations, in Ullmann's Encyclopedia of Industrial Chemistry, Vol. B3; Chapter 11, pp. 1–27, VCH: Weinheim; and Dechow, F. J. (1989) Separation and purification techniques in biotechnology, Noyes Publications).

In addition to measuring the end product of the fermentation, it is likewise possible to analyze other components of the metabolic pathways, which are used for producing the compound of interest, such as intermediates and byproducts, in order to determine the overall productivity of the organism, the yield and/or the efficiency of production of the compound. The analytical methods include measuring the amounts of nutrients in the medium (for example sugars, hydrocarbons, nitrogen sources, phosphate and other ions), measuring biomass composition and growth, analyzing the production of common metabolites from biosynthetic pathways and measuring gases generated during fermentation. Standard methods for these measurements are described in Applied Microbial Physiology; A Practical Approach, P. M. Rhodes and P. F. Stanbury, editors IRL Press, pp. 103–129; 131–163 and 165–192 (ISBN: 0199635773) and the references therein.

Example 10

Purification of the Product of Interest from a *C. glutamicum* Culture

The product of interest may be obtained from *C. glutamicum* cells or from the supernatant of the above-described culture by various methods known in the art. If the product of interest is not secreted by the cells, the cells may be harvested from the culture by slow centrifugation, and the cells may be lysed by standard techniques such as mechanial force or sonication. The cell debris is removed by centrifugation and the supernatant fraction which contains the soluble proteins is obtained for further purification of the compound of interest. If the product is secreted by the *C. glutamicum* cells, the cells are removed from the culture by slow centrifugation and the supernatant fraction is retained for further purification.

The supernatant fraction from both purification methods is subjected to chromatography using a suitable resin, and either the molecule of interest is retained on the chromatography resin while many contaminants in the sample are not or the contaminants remain on the resin while the sample does not. If necessary, these chromatography steps can be repeated using the same or different chromatography resins. The skilled worker is familiar with the selection of suitable chromatography resins and the most effective application for a particular molecule to be purified. The purified product may be concentrated by filtration or ultrafiltration and stored at a temperature at which product stability is highest.

In the art, many purification methods are known which are not limited to the above purification method and which are described, for example, in Bailey, J. E. & Ollis, D. F. Biochemical Engineering Fundamentals, McGraw-Hill: New York (1986).

The identity and purity of the isolated compounds can be determined by standard techniques of the art. These techniques comprise high performance liquid chromatography (HPLC), spectroscopic methods, coloring methods, thin-layer chromatography, NIRS, enzyme assays or microbiological assays. These analytical methods are compiled in: Patek et al. (1994) Appl. Environ. Microbiol. 60: 133–140; Malakhova et al. (1996) Biotekhnologiya 11: 27–32; and Schmidt et al. (1998) Bioprocess Engineer. 19: 67–70. Ulmann's Encyclopedia of Industrial Chemistry (1996) Vol. A27, VCH: Weinheim, pp. 89–90, pp. 521–540, pp. 540–547, pp. 559–566, pp. 575–581 and pp. 581–587; Michal, G. (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

Equivalents

The skilled worker knows, or can identify by using simply routine methods, a large number of equivalents of the specific embodiments of the invention. These equivalents are intended to be included in the patent claims below.

The information in Table 1 is to be understood as follows:

In column 1, "DNA ID", the relevant number refers in each case to the SEQ ID NO of the enclosed sequence listing. Consequently, "5" in column "DNA ID" is a reference to SEQ ID NO:5.

In column 2, "AA ID", the relevant number refers in each case to the SEQ ID NO of the enclosed sequence listing. Consequently, "6" in column "AA ID" is a reference to SEQ ID NO:6.

In column 3, "Identification", an unambiguous internal name for each sequence is listed.

In column 4, "AA pos", the relevant number refers in each case to the amino acid position of the polypeptide sequence "AA ID" in the same row. Consequently, "26" in column "AA pos" is amino acid position 26 of the polypeptide sequence indicated accordingly. Position counting starts at the N terminus with +1.

In column 5, "AA wild type", the relevant letter refers in each case to the amino acid, displayed in the one-letter code, at the position in the corresponding wild-type strain, which is indicated in column 4.

In column 6, "AA mutant", the relevant letter refers in each case to the amino acid, displayed in the one-letter code, at the position in the corresponding mutant strain, which is indicated in column 4.

In column 7, "Function", the physiological function of the corresponding polypeptide sequence is listed.

One-letter code of the proteinogenic amino acids:

A Alanine
C Cysteine
D Aspartic acid
E Glutamic acid
F Phenylalanine
G Glycine
H His
I Isoleucine
K Lysine
L Leucine
M Methionine
N Asparagine
P Proline
Q Glutamine
R Arginine
S Serine
T Threonine
V Valine
W Tryptophan
Y Tyrosine

TABLE 1

Genes coding for regulatory proteins

| DNA ID: | AA ID: | Identification: | AA pos.: | AA wild type | AA mutant | Function: |
|---|---|---|---|---|---|---|
| 1 | 2 | RXA00116 | 26 | L | F | ASPARTATE AMINOTRANSFERASE (EC 2.6.1.1) |
| 3 | 4 | RXA00147 | 144 | I | L | CARBAMOYL-PHOSPHATE SYNTHASE SMALL CHAIN (EC 6.3.5.5) |
|   |   |   | 239 | G | S | CARBAMOYL-PHOSPHATE SYNTHASE SMALL CHAIN (EC 6.3.5.5) |
| 5 | 6 | RXA00152 | 96 | P | S | STOMATIN LIKE PROTEIN |
|   |   |   | 237 | G | S | STOMATIN LIKE PROTEIN |
| 7 | 8 | RXA00166 | 103 | T | I | METHYLTRANSFERASE (EC 2.1.1.—) |
| 9 | 10 | RXA00278 | 144 | G | D | GLUTAMINE-BINDING PROTEIN PRECURSOR |
| 11 | 12 | RXA00323 | 41 | A | V | GLUTAMINE SYNTHETASE (EC 6.3.1.2) |
|   |   |   | 80 | G | E | GLUTAMINE SYNTHETASE (EC 6.3.1.2) |
| 13 | 14 | RXA00330 | 492 | T | I | THREONINE SYNTHASE (EC 4.2.99.2) |
| 15 | 16 | RXA00383 | 57 | A | T | PROTOPORPHYRINOGEN OXIDASE (EC 1.3.3.4) |
| 17 | 18 | RXA00389 | 55 | A | T | oxoglutarate semialdehyde dehydrogenase (EC 1.2.1.—) |
|   |   |   | 481 | G | E | axoglutarate semialdehyde dehydrogenase (EC 1.2.1.—) |
| 19 | 20 | RXA00416 | 223 | A | V | Hypothetical Membrane Spanning Protein |
| 21 | 22 | RXA00489 | 338 | S | F | GMP REDUCTASE (EC 1.6.6.8) |
| 23 | 24 | RXA00552 | 295 | A | T | THIOSULFATE SULFURTRANSFERASE (EC 2.8.1.1) |
| 25 | 26 | RXA00579 | 490 | P | L | PARA-AMINOBENZOATE SYNTHASE COMPONENT I (EC 4.1.3.—) |
| 27 | 28 | RXA00620 | 141 | G | D | PHOSPHORIBOSYLAMINOIMIDAZOLE-SUCCINOCARBOXAMIDE SYNTHASE (EC 6.3.2.6) |
| 29 | 30 | RXA00636 | 146 | E | K | Oxidoreductase FAD-binding |
| 31 | 32 | RXA00708 | 256 | G | S | 2,5-DIKETO-D-GLUCONIC ACID REDUCTASE (EC 1.1.1.—) |
| 33 | 34 | RXA00727 | 78 | P | S | GLUTAMINE-BINDING PERIPLASMIC PROTEIN PRECURSOR |
|   |   |   | 149 | A | V | GLUTAMINE-BINDING PERIPLASMIC PROTEIN PRECURSOR |
|   |   |   | 280 | A | V | GLUTAMINE-BINDING PERIPLASMIC PROTEIN PRECURSOR |
| 35 | 36 | RXA00867 | 513 | P | S | POLYRIBONUCLEOTIDE NUCLEOTIDYLTRANSFERASE (EC 2.7,7.8) |
| 37 | 38 | RXA00955 | 180 | A | V | INDOLE-3-GLYCEROL PHOSPHATE SYNTHASE (EC 4.1.1.48)/N-(5'-PHOSPHO-RIBOSYL)ANTHRANILATE ISOMERASE (EC 5.3.1.24) |
|   |   |   | 490 | L | F | INDOLE-3-GLYCEROL PHOSPHATE SYNTHASE (EC 4.1.1.48)/N-(5'-PHOSPHO-RIBOSYL)ANTHRANILATE ISOMERASE (EC 5.3.1.24) |
| 39 | 40 | RXA00957 | 220 | P | L | ANTHRANILATE SYNTHASE COMPONENT I (EC 4.1.3.27) |

TABLE 1-continued

Genes coding for regulatory proteins

| DNA ID: | AA ID: | Identification: | AA pos.: | AA wild type | AA mutant | Function: |
|---|---|---|---|---|---|---|
| 41 | 42 | RXA00970 | 133 | A | V | HOMOSERINE KINASE (EC 2.7.1.39) |
|  |  |  | 138 | P | S | HOMOSERINE KINASE (EC 2.7.1.39) |
| 43 | 44 | RXA00997 | 117 | A | V | 3-DEMETHYLUBIQUINONE-9 3-METHYLTRANSFERASE (EC 2.1.1.64) |
| 45 | 46 | RXA01095 | 262 | P | S | INDOLE-3-GLYCEROL PHOSPHATE SYNTHASE (EC 4.1.1.48) |
| 47 | 48 | RXA01105 | 270 | A | V | HISTIDINOL-PHOSPHATE AMINOTRANSFERASE (EC 2.6.1.9) |
| 49 | 50 | RXA01115 | 72 | T | I | 3-OXOADIPATE ENOL-LACTONE HYDROLASE (EC 3.1.1.24)/4-CARBOXY-MUCONOLACTONE DECARBOXYLASE (EC 4.1.1.44) |
| 51 | 52 | RXA01127 | 60 | D | N | 3-ISOPROPYLMALATE DEHYDROGENASE (EC 1.1.1.85) |
| 53 | 54 | RXA01240 | 23 | A | T | GTP PYROPHOSPHOKINASE (EC 2.7.6.5) |
| 55 | 56 | RXA01253 | 112 | A | T | COBYRIC ACID SYNTHASE (EC 3.—.—.—) |
| 57 | 58 | RXA01321 | 156 | V | A | FORMYLTETRAHYDROFOLATE DEFORMYLASE (EC 3.5.1.10) |
| 59 | 60 | RXA01381 | 180 | G | D | THIF PROTEIN |
| 61 | 62 | RXA01434 | 957 | S | F | VIRULENCE FACTOR MVIN |
|  |  |  | 1012 | P | S | VIRULENCE FACTOR MVIN |
| 63 | 64 | RXA01442 | 122 | R | H | PHOSPHORIBOSYLGLYCINAMIDE FORMYLTRANSFERASE 2 (EC 2.1.2.—) |
| 65 | 66 | RXA01483 | 200 | R | C | DEOXYGUANOSINETRIPHOSPHATE TRIPHOSPHOHYDROLASE (EC 3.1.5.1) |
|  |  |  | 326 | P | S | DEOXYGUANOSINETRIPHOSPHATE TRIPHOSPHOHYDROLASE (EC 3.1.5.1) |
| 67 | 68 | RXA01515 | 239 | A | V | DIHYDROPTEROATE SYNTHASE (EC 2.5.1.15) |
| 69 | 70 | RXA01518 | 148 | A | T | Hypothetical Membrane Spanning Protein |
| 71 | 72 | RXA01690 | 184 | G | D | BRANCHED-CHAIN AMINO ACID AMINOTRANSFERASE (EC 2.6.1.42) |
| 73 | 74 | RXA01746 | 146 | G | E | LIPOATE-PROTEIN LIGASE B (EC 6.—.—.—) |
| 75 | 76 | RXA01810 | 263 | G | S | HEMIN-BINDING PERIPLASMIC PROTEIN HMUT PRECURSOR |
| 77 | 78 | RXA01850 | 1 | V | M | L-SERINE DEHYDRATASE (EC 4.2.1.13) |
|  |  |  | 45 | S | N | L-SERINE DEHYDRATASE (EC 4.2.1.13) |
| 79 | 80 | RXA01940 | 269 | A | V | INOSINE-URIDINE PREFERRING NUCLEOSIDE HYDROLASE (EC 3.2.2.1) |
| 81 | 82 | RXA02021 | 305 | S | F | 2,3,4,5-TETRAHYDROPYRIDINE-2-CARBOXYLATE N-SUCCINYLTRANSFERASE (HOMOLOG) |
| 83 | 84 | RXA02095 | 409 | A | V | ABC TRANSPORTER ATP-BINDING PROTEIN |
|  |  |  | 914 | A | V | ABC TRANSPORTER ATP-BINDING PROTEIN |
| 85 | 86 | RXA02156 | 48 | A | T | ACETYLGLUTAMATE KINASE (EC 2.7.2.8) |
| 87 | 88 | RXA02162 | 434 | T | I | ARGININOSUCCINATE LYASE (EC 4.3.2.1) |
| 89 | 90 | RXA02176 | 136 | P | S | PHOSPHOSERINE AMINOTRANSFERASE (EC 2.6.1.52) |
| 91 | 92 | RXA02194 | 129 | L | F | ATP PHOSPHORIBOSYLTRANSFERASE (EC 2.4.2.17) |
| 93 | 94 | RXA02206 | 73 | G | D | OXIDOREDUCTASE (EC 1.1.1.—) |
|  |  |  | 114 | A | T | OXIDOREDUCTASE (EC 1.1.1.—) |
|  |  |  | 314 | R | C | OXIDOREDUOTASE (EC 1.1.1.—) |
| 95 | 96 | RXA02237 | 78 | D | N | GUANYLATE KINASE (EC 2.7.4.8) |
| 97 | 98 | RXA02239 | 168 | P | S | PHOSPHOPANTOTHENATE--CYSTEINE LIGASE (EC 6.3.2.5)/PHOSPHOPANTO-THENOYLCYSTEINE DECARBOXYLASE (EC 4.1.1.36) |
| 99 | 100 | RXA02250 | 24 | P | S | RIBX PROTEIN |
| 101 | 102 | RXA02295 | 130 | G | D | TRANSPORTER |
| 103 | 104 | RXA02299 | 36 | A | V | ASPARTATE 1-DECARBOXYLASE (EC 4.1.1.11) |
| 105 | 106 | RXA02324 | 416 | E | K | GAMMA-GLUTAMYL PHOSPHATE REDUCTASE (GPR) (EC 1.2.1.41) |
| 107 | 108 | RXA02390 | 195 | G | D | THREONINE EFFLUX PROTEIN |
| 109 | 110 | RXA02499 | 65 | G | S | PYRROLINE-5-CARBOXYLATE REDUCTASE (EC 1.5.1.2) |
|  |  |  | 216 | A | T | PYRROLINE-5-CARBOXYLATE REDUCTASE (EC 1.5.1.2) |
| 111 | 112 | RXA02516 | 158 | P | S | CYSTEINE DESULFHYDRASE (EC 4.4.1.—)/SELENOCYSTEINE LYASE (EC 4.4.1.16) |
| 113 | 114 | RXA02532 | 284 | P | S | CYSTATHIONINE GAMMA-SYNTHASE (EC 4.2.99.9) |
| 115 | 116 | RXA02536 | 132 | P | S | Carbon-nitrogen hydrolase |
| 117 | 118 | RXA02560 | 138 | G | E | OXYGEN-INSENSITIVE NAD(P)H NITROREDUCTASE (EC 1.—.—.—)/DIHY-DROPTERIDINE REDUCTASE (EC 1.6.99.7) |
|  |  |  | 192 | P | S | OXYGEN-INSENSITIVE NAD(P)H NITROREDUCTASE (EC 1.—.—.—)/DIHY-DROPTERIDINE REDUCTASE (EC 1.6.99.7) |
| 119 | 120 | RXA02653 | 448 | G | E | pyridoxal-dependent decarboxylase |
| 121 | 122 | RXA02754 | 374 | P | S | NICOTINATE PHOSPHORIBOSYLTRANSFERASE (EC 2.4.2.11) |
| 123 | 124 | RXA02758 | 110 | G | E | PHOSPHOSERINE PHOSPHATASE (EC 3.1.3.3) |
| 125 | 126 | RXA02790 | 30 | L | F | 4-AMINO-4-DEOXYCHORISMATE LYASE (EC 4.—.—.—) |
| 127 | 128 | RXA02912 | 62 | G | D | METHYLTRANSFERASE (EC 2.1.1.—) |
| 129 | 130 | RXA02970 | 233 | E | K | AMINOTRANSFERASE |
| 131 | 132 | RXA03003 | 209 | P | L | ASPARTATE AMINOTRANSFERASE (EC 2.6.1.1) |
| 133 | 134 | RXA03171 | 70 | P | S | URACIL PHOSPHORIBOSYLTRANSFERASE (EC 2.4.2.9) |
|  |  |  | 144 | L | F | URACIL PHOSPHORIBOSYLTRANSFERASE (EC 2.4.2.9) |
|  |  |  | 199 | A | V | URACIL PHOSPHORIBOSYLTRANSFERASE (EC 2.4.2.9) |
| 135 | 136 | RXA03282 | 312 | G | D | CYSTATHIONINE GAMMA-SYNTHASE (EC 4.2.99.9) |
| 137 | 138 | RXA03465 | 224 | P | S | MOLYBDENUM COFACTOR BIOSYNTHESIS PROTEIN A |
|  |  |  | 261 | P | S | MOLYBDENUM COFACTOR BIOSYNTHESIS PROTEIN A |
| 139 | 140 | RXA03677 | 389 | A | T | TREHALOSE/MALTOSE BINDING PROTEIN |
| 141 | 142 | RXA03695 | 70 | T | I | METHYLTRANSFERASE (EC 2,1.1.—) |
| 143 | 144 | RXA03754 | 459 | G | D | 3-ISOPROPYLMALATE DEHYDRATASE LARGE SUBUNIT (EC 4.2.1.33) |
| 145 | 146 | RXA03829 | 36 | A | T | PROBABLE ACETOLACTATE SYNTHASE FAMILY |
| 147 | 148 | RXA03871 | 33 | R | H | MOLYBDOPTERIN BIOSYNTHESIS MOEA PROTEIN |
|  |  |  | 360 | T | I | MOLYBDOPTERIN BIOSYNTHESIS MOEA PROTEIN |

TABLE 1-continued

Genes coding for regulatory proteins

| DNA ID: | AA ID: | Identification: | AA pos.: | AA wild type | AA mutant | Function: |
|---|---|---|---|---|---|---|
| 149 | 150 | RXA04120 | 348 | G | D | GAMMA-GLUTAMYLTRANSPEPTIDASE (EC 2.3.2.2) |
| 151 | 152 | RXA04173 | 41 | T | I | GMP synthase - Glutamine amidotransferase domain |
| 153 | 154 | RXA04174 | 856 | G | S | ACONITATE HYDRATASE (EC 4.2.1.3) |
| 155 | 156 | RXA04186 | 385 | A | T | 5-METHYLTETRAHYDROFOLATE--HOMOCYSTEINE METHYLTRANSFERASE (EC 2.1.1.13) |
|  |  |  | 492 | V | I | 5-METHYLTETRAHYDROFOLATE--HOMOCYSTEINE METHYLTRANSFERASE (EC 2.1.1.13) |
|  |  |  | 990 | S | N | 5-METHYLTETRAHYDROFOLATE--HOMOCYSTEINE METHYLTRANSFERASE (EC 2.1.1.13) |
| 157 | 158 | RXA04228 | 279 | A | T | GLUTAMINASE (EC 3.5.1.2) |
| 159 | 160 | RXA04360 | 161 | P | S | ANTHRANILATE PHOSPHORIBOSYLTRANSFERASE (EC 2.4.2.18) |
| 161 | 162 | RXA07000 | 398 | P | S | GLUTAMATE SYNTHASE [NADPH] LARGE CHAIN (EC 1.4.1.13) |
| 163 | 164 | RXA07001 | 110 | A | T | MALTOSE-BINDING PROTEIN PRECURSOR |

SEQUENCE LISTING (164 sequences)

SEQ ID NO: 1 - DNA, 1339 bp, Corynebacterium glutamicum
  CDS (101)..(1309): RXA00116
gcaccctctctttttttgtgtttgtgggggtcttgggccccttgtgcacgcggcacgcacgctgggggcaagcgtcgacaagcacaaactttttgcttaattgaatcctttgcgcaccaatcaatgggggatcaaatatagtagctgcatgagtaatgacttcgtcgtttctaggcttagaccctttggtgaaacgatttttgcaaccatgacccagcgagctgttgaggcgggtgcaatcaatcttggtcagggctttcctgatgaggatggtcctcgtcggatgttagagatcgcgtcggagcagattctcgggggaaataatcagtattcggcggggcgtggggatgcttcgttgagggcagctgtggctcgtgatcatttggagaggtttgatctggagtacaaccctgattcggaggtgttgatcacggtgggggccactgaggcgattacggcgactgtgttgggtttggtggagcctggggatgaagtgatcgttttggaaccgtattacgatgcgtatgcggcggctattgcgttggcgggggcgacgcgggtggcggttcctttgcaggaggtggagaactcgtgggatgtggatgtcgataagttgcatgcggcggtgactaagaagacgcggatgattatcgttaattcgccgcataatccgacgggttcggtgttttctaagaaggcgttgaagcagttggcgggtgttgctcgtgcgtatgacttgttggtgttgtcagatgaggtgtatgagcatcttgtttttgatgatcagaagcatgtgagtgtcgcgaagctgcccggtatgtgggatcgcacggtgacggtgtcgtcggcggcgaaaacgttcaatgtgactggttggaagacggggtgggcgttggcaccggagccgttgttggaggcggtgttgaaggcgaagcagtttatgtcttatgtgggggctacaccttttcagccggctgtggcgcatgcgattgaacatgagcagaagtgggtgtcaaagatgtctaaggggcttgagctcaagcgggatattttgcgtactgcgttagataaggcggggctgaagactcatgacagtatgggcacgtatttcatcgttgcggatattggggatcgtgatggtgcggagttctgttttgagttgattgagaaggttggggtggcggcgattccggtgcaggcgtttgtggatcatccgaagaagtggtcgtcgaaggttcgttttgcgttttgcaaaaaagaagagacgctccgcgaagctgcggagcgtctcaaggggattaagaaactatagtttgaacaggttgttgggggtcttttt

SEQ ID NO: 2 - protein, 403 aa, Corynebacterium glutamicum
LNPLRTNQWGIKYSSCMSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 3 - DNA, 1309 bp, Corynebacterium glutamicum
  CDS (101)..(1279): RXA00147
attgcatataatgcaatgaattgaataaactacattcagggttatcaaccagccaatttcttttaaaaaggcagacacacgaaaggcgacaacagtcaccgtgagtaaagacaccaccacctaccagggagtcaccgagatcggatccgttccggcatacctggttcttgcagacggacgtaccttcaccggatttggctttggagctatcggcaccacccttggtgaggcagtgttcactaccgccatgaccggttaccaagaaaccatgaccgatccttcctatcaccgccagattgttgtggctaccgcaccacagatcggcaacaccggctggaacgatgaggacaacgagtcccgcgacggcaagatttgggttgcaggccttgttatccgcgacctcgcagcacgtgtgtccaactggcgcgccaccacctccttgcagcaggaaatggcaggccagggcatcgtcggcatcggcggaatcgacacccgcgcactggttcgccacctgcgcaatgaaggttccattgcagcgggcatcttctccggcgctgacgcacagcgcccagttgaagaactcgtagagatcgtcaagaatcagccagcaatgaccggcgcaaacctctccgttgaggtctctgctgatgaaacctacgtcatcgaagctgaaggcgaagagcgccacaccgtcgtggcctacgacctgggcattaagcaaaacaccccacgtcgtttctctgcacgcggtgttcgcaccgtcatcgtgcctgctgaaaccccattcgaggatatcaagcagtacaacccatcaggcgtgttcatctccaacggccctggcgatcctgcagcagcagacgtcatggttgatatcgtccgcgaagttcttgaagccgacattccattctttggcatctgcttcggcaaccagattcttggccgcgcattcggcatggagacctacaagctgaagttcggccaccgcggcatcaacgttccagtgaagaaccacatcaccggcaagatcgacatcaccgcccagaaccacggcttcgcactcaagggtgaagcaggccaggaattcgagaccgatttcggcactgcaattgtcacccacacctgcctcaacgacggcgtcgttgaaggtattgcgctgaagtccggacgcgcatactccgttcagtaccacccagaggccgctgccggcccaaatgatgcaagccccctgtttgaccagtttgttgagctgatggatgcagacgctcagaagaaaggcgcataaataacatgccaaagcgttcagatatta

SEQ ID NO: 4 - protein, 393 aa, Corynebacterium glutamicum
VSKDTTTYQGVTEIGSVPAYLVLADGRTFTGFGFGAIGTTLGEAVFTTAMTGYQETMTDPSYHRQIVVATAPQIGNTGWNDEDNESRDGKIWVAGLVIRDLAARVSNWRATTSLQQEMAGQGIVGIGGIDTRALVRHLRNEGSIAAGIFSGADAQRPVEELVEIVKNQPAMTGANLSVEVSADETYVIEAEGEERHTVVAYDLGIKQNTPRRFSARGVRTVIVPAETPFEDIKQYNPSGVFISNGPGDPAAADVMVDIVREVLEADIPFFGICFGNQILGRAFGMETYKLKFGHRGINVPVKNHITGKIDITAQNHGFALKGEAGQEFETDFGTAIVTHTCLNDGVVEGIALKSGRAYSVQYHPEAAAGPNDASPLFDQFVELMDADAQKKGA

SEQ ID NO: 5 - DNA, 1426 bp, Corynebacterium glutamicum
  CDS (101)..(1396): RXA00152
gtcattgatatccaaggcacgaccgcgattgtatggaaagaagcctaaatttttaacaatcaaatagtactggccattcccaactaaaactggagtaacgatgacaggactaatcctcgccatagttttcctggtctttgtcgccgtcgtggtgatcaagtccatagccctgattccccagggtgaagccgccgtcattgaacgccttggtagctacacccgcaccgtttcaggtggcctgaccctgctggttccattcgtggaccgagtacgcgcaaggatcgacacccgtgagcgcgtggtctcattcccaccgcaggctgttattacccaagacaacctgaccgtggccatcgatatcgtggtgaccttccaaatcaacgaaccagagcgcgccatctacggcgtggacaactacatcgtcggtgtggagcagatttctgtagcaacacttcgagacgttgtcggtggcatgaccctggaagaaaccctcacttcacgtgacgtgatcaaccgccgcctccgtggcgagctcgatgcagcaaccaccaaatggggcctgcgcatcagccgtgtggaactaaaggcaattgatccgccaccatccatccagcaatcgatggaaaagcagatgaaggcagaccgtgaaaagcgcgccaccattttgaccgcagaaggtcagcgcgaagccgacatcaaaactgccgaaggtgaaaagcaagccaagatcctccaagctgagggtgaaaagcacgcatccatcctgaacgcagaagcagaacgccaagcgatgatcctgcgcgccgaaggtgaacgcgcagcacgctacctccaggcgcagggtgaagcccgagcaatccaaaaggtcaacgcagcaatcaagtctgccaagttgaccccagaggttcttgcttatcaatacctcgaaaagcttcctaagatcgcagagggcaacgcctccaagatgtgggtcatcccaagccagttctccgattctctggaaggttttgcgaagcagttcggcgcaaaggatgcagaaggtgtcttccgctacgaaccaaacaccgtggatgaagaaacccgcgacatcgcaaacgccgacaacgtggaagactggttctccaccgaatcagaccctgaaatcgcagcagcagtcgccgcagcaaacgccgtggccaacaagccagtcgatccagaacccggtgagatcctttccaagaagaccgcacgacgcgttgaacctgaagcagtattggaggctttgcaaaacggaaccactacacaacctgaggttgaggcagcacctcctaccgcaaacttcgcccaagaattccctgcaccacaggcaaaccctgaagattactccgaccaacaccgagagaatccttacggaaactaatcaggcataagaaaaggcgggaaacac

SEQ ID NO: 6 - protein, 432 aa, Corynebacterium glutamicum
MTGLILAIVFLVFVAVVVIKSIALIPQGEAAVIERLGSYTRTVSGGLTLLVPFVDRVRARIDTRERVVSFPPQAVITQDNLTVAIDIVVTFQINEPERAIYGVDNYIVGVEQISVATLRDVVGGMTLEETLTSRDVINRRLRGELDAATTKWGLRISRVELKAIDPPPSIQQSMEKQMKADREKRATILTAEGQREADIKTAEGEKQAKILQAEGEKHASILNAEAERQAMILRAEGERAARYLQAQGEARAIQKVNAAIKSAKLTPEVLAYQYLEKLPKIAEGNASKMWVIPSQFSDSLEGFAKQFGAKDAEGVFRYEPNTVDEETRDIANADNVEDWFSTESDPEIAAAVAAANAVANKPVDPEPGEILSKKTARRVEPEAVLEALQNGTTTQPEVEAAPPTANFAQEFPAPQANPEDYSDQHRENPYGN

SEQ ID NO: 7 - DNA, 1048 bp, Corynebacterium glutamicum
  CDS (101)..(1018): RXA00166
tgcgacaacgccactttgagagtccataatttggcatccaacgccggcatcttggacggtcgcgcgccgggcccggggaggtttttatacctatctaaaggtgtggatttcgtttgttgcacaaggagatactgtatctcatgagcacgttaagcgatatatcgctagtgaaggtggtggtagcccgctaggattaacatctgatatgaatgatccagctcatcccccaattccaccagtatcaaaacgagacgctccggcgtttagcgatcttcaacatcgagcaaccagcgccagcgcttttacccaaggcagcacgacttatcacgatgtccgacctggatatccggctgaggccgtggagttagcccgtgggtttggccgagtcctggatgtcggtgcaggtaccggaaaactaaccagtgagctaacagctgatcaggtcctagcccttgatccaagcatggacatgttgcgggtgtttcgctccgcgcttccggcggttccctgctggcaagcgacagcagaacacacaggaatacgtgacaacgcggttgatctgattacgtgcgcacaaacgtggcattgggttgacgtgacggctgcctcagcggaatttgatcgggtgattgcacctgagggtgcagtcctgctcgtgtggaataacctggacacctccatcgcgtgggtacaccgactcagtcgcattatgcatgccggcgatgtactcaagccgggattcaccccagaaaccgcagctccctggataattgatcgagaaattcgcaccacgtggaatcagcacctcacccctgaagaaatcatccagctcgctcacacgaggtcctactggttaaacgcgtcagagaaaatcaaagagcgtgttgatcagaaccttcagtggtatctctacgagcatttgggtttcagtcccgacaatccagtggaacttccctatcgctgtgatgcatttttactttcacgttccggtaccctggcaggcagatcttccaatctttaggagccctcgccatgtacctgttgaatc

SEQ ID NO: 8 - protein, 306 aa, Corynebacterium glutamicum
VWISFVAQGDTVSHEHVKRYIASEGGGSPLGLTSDMNDPAHPPIPPVSKRDAPAFSDLQHRATSASAFTQGSTTYHDVRPGYPAEAVELARGFGRVLDVGAGTGKLTSELTADQVLALDPSMDMLRVFRSALPAVPCWQATAEHTGIRDNAVDLITCAQTWHWVDVTAASAEFDRVIAPEGAVLLVWNNLDTSIAWVHRLSRIMHAGDVLKPGFTPETAAPWIIDREIRTTWNQHLTPEEIIQLAHTRSYWLNASEKIKERVDQNLQWYLYEHLGFSPDNPVELPYRCDAFLLSRSGTLAGRSSNL

SEQ ID NO: 9 - DNA, 1162 bp, Corynebacterium glutamicum
  CDS (101)..(1132): RXA00278
ggccacggagttggtgtccgtcatggtgatgattctgtctgtcgtttctgtgttggctttgtgggtcggcatccgcccccgtttgcaggagtacttataaatgcacgcttttcgacgcccccctccactcaccacgcgagtcggcgctgcattgctggccgcaacgctgcttgcttcctgcactccaacacctgtggaaccggcagaaaccttgactgctttggatcccgatgccggtccaccactgccaccggattcttcgattgaagctcccggtgaaaaagagcccattgtggaagtaatagagaattggccaggttctttacgcccggatgatctgacccctgaggagcgggtacctggcatcgtcaaccggggtcgcatcattgtgggtgtggatcaatcgcaaaacttgctcagtttccgtgatccggtgactggtgagctgcgcggttttgaagtggaattagcgagggaaatttcccgcgacattttcggtgaccccaataaggtggatttccgattcgtcggctcgtccgaccgtctgcgttcccttgaccaaggtgatgtagatattgtgattcgttccgtcacgatcaccgacgaacgcgccaaattggtggaattttccacaccgtacctgcgcacccaaacccgcatgttgaccatggaatcttcaggaatcacgtccatcgcagatctacccggccacaccatttgtgtcaccgatggctccacttcattgcagcgagcccgcaccattgcgccggaggcctcaatcttaaaaactcgcaattggtccgattgtctcatggcgttgcagcagcatcaggctcaggtcattttgggcgatgatgtcattttgtccggcatcgcagcacaggatccctacaccgagattcttgatacctccctcgattcccattcctatggagtggcagcggcatcgaccactgctgaaacagactcttcggggttgattcggcaggtaaactacacaattgaacggatccgcacagaccgcatgtggtggacaatgttcgacgattggttcggaccttatctctggtcctacggtccaccacagctgcagtacatgccagaggaagaagggacagaaaacgatgaaggataatgaagatttcgatccagattcaccagc

SEQ ID NO: 10 - protein, 344 aa, Corynebacterium glutamicum
MHAFRRPPPLTTRVGAALLAATLLASCTPTPVEPAETLTALDPDAGPPLPPDSSIEAPGEKEPIVEVIENWPGSLRPDDLTPEERVPGIVNRGRIIVGVDQSQNLLSFRDPVTGELRGFEVELAREISRDIFGDPNKVDFRFVGSSDRLRSLDQGDVDIVIRSVTITDERAKLVEFSTPYLRTQTRMLTMESSGITSIADLPGHTICVTDGSTSLQRARTIAPEASILKTRNWSDCLMALQQHQAQVILGDDVILSGIAAQDPYTEILDTSLDSHSYGVAAASTTAETDSSGLIRQVNYTIERIRTDRMWWTMFDDWFGPYLWSYGPPQLQYMPEEEGTENDEG

SEQ ID NO: 11 - DNA, 1558 bp, Corynebacterium glutamicum
  CDS (101)..(1528): RXA00323
ttccttattcgtaggagtgttctaatttcggtgcggttctcagtgaaccacccaagctggacacctcccacccccgtgtcatcaaaaaaccgcgacatccttgagtaactctgagaaaaactacccccgatgggagtataaaagtggcaaatgcgcagtcgatgtcccatcgctgcgtagattagttttcatgaacagcgaacaggaatttgtactcagcgccattgaagaacgcgacattaagtttgtgcgtctatggttcactgacattcttggccacttgaagtcagtggttgtggctcctgcagaactagagtctgcgttggaagaaggcatcggattcgatggctcagccattgagggctacgcgcgtatctcggaagcggacaccattgcccgcccagatccatcgacattccaggtcctcccactagaagcgggcatctcaaaactgcaggcagcacgcctgttttgcgatgtcacgatgccagacggacagccatctttttctgacccgcgccaagtgctgcgcaggcaggtccaactagctgcagatgaaggcttgacctgcatgatctcaccagagattgagttctatttggtgcaaagccttcgcaccaacggactgccacctgtgcccactgacaacggcggatatttcgaccaagccacattcaatgaggcgccgaatttccgtcgaaacgcgatggtagcgctggaggaactcggcatccctgtcgagttctcccaccatgaaactgcacctggccagcaagaaatcgatttacgccatgcggatgcgctcaccatggccgacaacatcatgaccttccgctacatcatgaaacaggtggcaagggaccaaggcgtcggggcatcatttatgcccaagccattccaagaacatgcaggctccgccatgcacacgcacatgtccttatttgagggcgataccaacgcgttccacgatccagacgattcttacatgctgtccaaaaccgcaaaacagttcatcgctggaatcttgcatcacgctccagaattcaccgctgtgaccaaccagtgggtcaattcctacaaacgcatcgtgtacggaaacgaagctccaactgcggcaacctggggtgtatctaatcgttctgcgctggttcgtgttcctacctaccgtttgaataaggaggagtcgcgccgggtggaggtgcgtcttcctgataccgcttgtaacccatatttggcgttttcagtgatgctcggcgctggtttgaaaggcattaaagaaggttatgagctcgacgagccagctgaggacgatatctccaacttgagcttccgggaacgtcgcgccatgggctacaacgatctgccaagcagccttgatcaggcactgcgccaaatggaaaagtcagagcttgttgctgacatcctcggtgagcacgtttttgagtttttcttgcgcaataagtggcgtgaatggcgtgactaccaagagcagatcactccgtgggagctccgaaacaatcttgattactagacttttgcactccaatggaaaccctac

SEQ ID NO: 12 - protein, 476 aa, Corynebacterium glutamicum
LSNSEKNYPRWEYKSGKCAVDVPSLRRLVFMNSEQEFVLSAIEERDIKFVRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 13 - DNA, 1615 bp, Corynebacterium glutamicum
  CDS (101)..(1585): RXA00330
atctttaaagcacatcctaaaaccgacaattgaaagtgatcagcaacactttagggtatcgcgtgggcgaagtcacctttttcaacatatttgagacggtgtgggggagtattgtgtcaccccttgggatagggttatatccgtggactacatttcgacgcgtgatgccagccgtacccctgcccgcttcagtgatattttgctgggcggtctagcaccagacggcggcctgtacctgcctgcaacctaccctcaactagatgatgcccagctgagtaaatggcgtgaggtattagccaacgaaggatacgcagctttggctgctgaagttatctccctgtttgttgatgacatcccagtagaagacatcaaggcgatcaccgcacgcgcctacacctacccgaagttcaacagcgaagacatcgttcctgtcaccgaactcgaggacaacatttacctgggccacctttccgaaggcccaaccgctgcattcaaagacatggccatgcagctgctcggcgaacttttcgaatacgagcttcgccgccgcaacgaaaccatcaacatcctgggcgctacctctggcgataccggctcctctgcggaatacgccatgcgcggccgcgagggaatccgcgtattcatgctgaccccagctggccgcatgaccccattccagcaagcacagatgtttggccttgacgatccaaacatcttcaacatcgccctcgacggcgttttcgacgattgccaagacgtagtcaaggctgtctccgccgacgcagaattcaaaaaagacaaccgcatcggtgccgtgaactccatcaactgggcacgccttatggcacaggttgtgtactacgtttcctcatggatccgcaccacaaccagcaatgaccaaaaggtcagcttctccgtaccaaccggcaacttcggtgacatttgcgcaggccacatcgcccgccaaatgggacttcccatcgatcgcctcatcgtggccaccaacgaaaacgatgtgctcgacgagttcttccgtaccggcgactaccgagtccgcagctccgcagacacccacgagacctcctcaccttcgatggatatctcccgcgcctccaacttcgagcgtttcatcttcgacctgctcggccgcgacgccacccgcgtcaacgatctatttggtacccaggttcgccaaggcggattctcactggctgatgacgccaactttgagaaggctgcagcagaatacggtttcgcctccggacgatccacccatgctgaccgtgtggcaaccatcgctgacgtgcattcccgcctcgacgtactaatcgatccccacaccgccgacggcgttcacgtggcacgccagtggagggacgaggtcaacaccccaatcatcgtcctagaaactgcactcccagtgaaatttgccgacaccatcgtcgaagcaattggtgaagcacctcaaactccagagcgtttcgccgcgatcatggatgctccattcaaggtttccgacctaccaaacgacaccgatgcagttaagcagtacatagtcgatgcgattgcaaacacttccgtgaagtaacttgctttacgccaaggcctgattcct

SEQ ID NO: 14 - protein, 495 aa, Corynebacterium glutamicum
VGEYCVTPWDRVISVDYISTRDASRTPARFSDILLGGLAPDGGLYLPATYPQLDDAQLSKWREVLANEGYAALAAEVISLFVDDIPVEDIKAITARAYTYPKFNSEDIVPVTELEDNIYLGHLSEGPTAAFKDMAMQLLGELFEYELRRRNETINILGATSGDTGSSAEYAMRGREGIRVFMLTPAGRMTPFQQAQMFGLDDPNIFNIALDGVFDDCQDVVKAVSADAEFKKDNRIGAVNSINWARLMAQVVYYVSSWIRTTTSNDQKVSFSVPTGNFGDICAGHIARQMGLPIDRLIVATNENDVLDEFFRTGDYRVRSSADTHETSSPSMDISRASNFERFIFDLLGRDATRVNDLFGTQVRQGGFSLADDANFEKAAAEYGFASGRSTHADRVATIADVHSRLDVLIDPHTADGVHVARQWRDEVNTPIIVLETALPVKFADTIVEAIGEAPQTPERFAAIMDAPFKVSDLPNDTDAVKQYIVDAIANTSVK

SEQ ID NO: 15 - DNA, 1474 bp, Corynebacterium glutamicum
  CDS (101)..(1444): RXA00383
ccatatctttaaccttggtcatggtgtgcttcctaatacggtggcggaagatattactgaagccgtctccatcattcattcttaaactaagaggagtttcatgcgttttgccatcatcggtgcaggccttgcgggtctgactgctgcatatgagatccataaagctgatcccactgcccaaatcgatgtgttggaagcaggcgaacgcattggcggcaagctttttacggtgccgtttgcttccggacctaccgatattggagcggaggcgtttttagctgcgcgttccgatgcggtggagttttttactgagcttgggttggctgattctttggtcagcccgtctgctgcgaagtctcagtatttcgcgggcggtgcgctgcatgcgttccccgcaggtggagtgatgggtattccaagcaatccaccagcaggcgcgcaagacaccgcttttgattggactcctggccaagacatttctgttggcgccttagtgcgccgtcagtatggcgatgagatcgtcgatactgtggtgtcttcgctgcttggtggcgtttattcctccaccgctgatgatctgggtgtgcgcgcttccgtgccggcacttgctgcagcccttgatcagctggctgaggccggcgagccggtgactctgtcagctgcggtcaaggccgtggaagctcagcgggaagccgcaaaaacaacttcagaaacccgccccgttttccagaccttcaagggcggatacgcggagctgtacgaagcgttggcagagcaatgcggtgcagatattcacttggatagtttcgtttccgccatcaccaaagatggtgaaggttttgccatcaagggcggtggcgaaggcacctacgacaaggtgattttggcggttcccgctccaaccgccgctgtgctgctccgcgacttggcaccggccgcagcgccacatttgcgcgcaattaagttggcttcttcagcagtcgtcggcatgcgtttcgattccagcgagggcctgcccgacaactccggcgtcctggtcgctgttaatgagccgggcatcacggcgaaggccttcacgttctcctcaaagaagtggcctcacctggaggctcgcgggggcgcgctcgtgcgcgcgtcgttcggcaggctaggcgatgaggcgtcggcacgcatggacgaggatttgcttgtcgacgccgccctcgacgatctcctcaccataaccgggttcgacggccgggctgccggactgggtgaaattttcgtgcagcgctggttcggtgggctcccagcctatggagttgatcacattgctaccgtttcggctgcgcgtgcagagatcgcagccgtgcctggcgtggaagcaattggcgcgtgggctgggggagtgggagttcccgcagttatcgcagatgcccaggcagcagtacacaggttgctgggataagcacccaaaaacactattgaccacccc

SEQ ID NO: 16 - protein, 448 aa, Corynebacterium glutamicum
MRFAIIGAGLAGLTAAYEIHKADPTAQIDVLEAGERIGGKLFTVPFASGPTDIGAEAFLAARSDAVEFFTELGLADSLVSPSAAKSQYFAGGALHAFPAGGVMGIPSNPPAGAQDTAFDWTPGQDISVGALVRRQYGDEIVDTVVSSLLGGVYSSTADDLGVRASVPALAAALDQLAEAGEPVTLSAAVKAVEAQREAAKTTSETRPVFQTFKGGYAELYEALAEQCGADIHLDSFVSAITKDGEGFAIKGGGEGTYDKVILAVPAPTAAVLLRDLAPAAAPHLRAIKLASSAVVGMRFDSSEGLPDNSGVLVAVNEPGITAKAFTFSSKKWPHLEARGGALVRASFGRLGDEASARMDEDLLVDAALDDLLTITGFDGRAAGLGEIFVQRWFGGLPAYGVDHIATVSAARAEIAAVPGVEAIGAWAGGVGVPAVIADAQAAVHRLLG

SEQ ID NO: 17 - DNA, 1690 bp, Corynebacterium glutamicum
  CDS (101)..(1660): RXA00389
ccaccactgcgtaacctttccgagcaagatatcgcggacctgtcggatttgcttgccacctctggcgcaggttcctaccgccttcagttgaggtgaaagcatgatcaccgcaaccgcactgcatgggtgttcactgattgatggcgagtgggtcgctggaaaaaatggtgagattacaggattcgatccgcgcaccaatgcgagtctgaacccttcctactctttagcaaacagcgcacagctgcgcgccgccacaacatcggcgaagcgagcttttgaaagctaccgactcactactccagaggttagagcagatttcctggattccatcgctgacaacatcgatgcgctatccggcgagatcgtgcaacgggcgagcctggagacaggtttgggaactacccgactcacaggcgaagtagcccgcaccagcaaccagctccgcctgtttgcagaaaccgtgagaagcggacagttccaccgagtacgcattgaacgaggaccgcggattgatcttcgccagcgtcaggttccgttgggaccagtcgcggtattcggggcaagcaacttccccgtcgctttctctactgctggtggcgatacagcatcagcgttggctgcaggctgccctgtggtttttaaggcgcataatgcgcaccctggaacagctgagctcgtcgggcaagcggtgcggggagccgtcgaaaagcatgagtttgatgctggtgtgtttaaccttgtctacggccgtggcgtggaaattggccaggagctggctgcggatccgaatatcacggcaatcggttttaccggttcacgccagggtggtttggcactgtcacagactgcgtttagccgcccagttcccgttccagtctttgcagaaatgagtgccaccaaccctgtgttcgtcttccccggcgcgctggcggatttggatgcatcgagttccttggctgaggcgtttaccgcttccgtcaccggcagttccgggcaattgtgcaccaagcctggcctcgttttcatcccgcgcggtgttgttggtgatgcttttgtggcgctcgtagcagccaaatttaaagaaaccacgggtcaaacgatgctcacgcaaggcatcgctcaggcatggcagcgcggagtcgacaaccttgcagcacagccaagtgtaaaaatcctcgcccaaggcacccccggagatggagagaacgcgccgggcccggtggtgtttgaaagtgatgtgcaggcgttgctaaataatgtggtgttgcaggaagaaatcttcggtgcggcatcgctggtggtgcgttatgattccccggatcaactccaccaagtagccaattcactcgagggacaattaacagccacgatccacgcatcccaggatgatttccaggaagtctcgaaacttatccccctcttggaggatctcgcgggccgtgttctttacggcggctggccaacgggtgtggaagttgggcacacggttatccatggaggcccttatccggcgacctcaaatgcgcagtcgacaagtgttggaaccctggcaatcgagagatttatgcgcccggtttcttatcaaactttcccggctgagctgcttccagatccagtttctgaggcgaataaatgggctgtacctcgggaaatagaccgttaatagctggtctttacatttgccagaaag

SEQ ID NO: 18 - protein, 520 aa, Corynebacterium glutamicum
MITATALHGCSLIDGEWVAGKNGEITGFDPRTNASLNPSYSLANSAQLRAATTSAKRAFESYRLTTPEVRADFLDSIADNIDALSGEIVQRASLETGLGTTRLTGEVARTSNQLRLFAETVRSGQFHRVRIERGPRIDLRQRQVPLGPVAVFGASNFPVAFSTAGGDTASALAAGCPVVFKAHNAHPGTAELVGQAVRGAVEKHEFDAGVFNLVYGRGVEIGQELAADPNITAIGFTGSRQGGLALSQTAFSRPVPVPVFAEMSATNPVFVFPGALADLDASSSLAEAFTASVTGSSGQLCTKPGLVFIPRGVVGDAFVALVAAKFKETTGQTMLTQGIAQAWQRGVDNLAAQPSVKILAQGTPGDGENAPGPVVFESDVQALLNNVVLQEEIFGAASLVVRYDSPDQLHQVANSLEGQLTATIHASQDDFQEVSKLIPLLEDLAGRVLYGGWPTGVEVGHTVIHGGPYPATSNAQSTSVGTLAIERFMRPVSYQTFPAELLPDPVSEANKWAVPREIDR

SEQ ID NO: 19 - DNA, 2161 bp, Corynebacterium glutamicum
  CDS (101)..(2131): RXA00416
caagctctgaaagcagatagcacgtgagactcattaatacatacttgtaattttgctcctcgatcccagcaatgctcgttgagtatgaaagacttctatcatgattaacacctctgaagatgaaggtgcagtcgtggttcatgaggatttgaatccttatggtccatcacgtgtgcctgaaggcgaagtgtatcggcctgatcgtctaaacaggaaagctacacttgttgcaattgtgggagctgccatcctggctttcgcatttgctttggtgttgtggatgggtttaaaacaaacaaaccttccagctttcggcccatcgaatgtcacgagggctgttgcttctgccaccatcgctgcggttttgattgtcacgggttttttgacgtggctgtggctgcgcgatgaacatcagagcaatccgcggtgggagttggaggacgtcaagccaaggcccaagtggcggacggcgctgacgtatctggcgtcttacttaagcccagctgcgctggtggttgcggtgttggctattccgctgtctgcgacccgcctgtatttggacggaatcagcgttgaccagggctttagaactcagtttttaacccgcatggctgacgatatcggcttgtcggacatgaactacatcgatatgcctaccttctaccctgctggatggttctggctcggtggtcgcttggccaatcttttggggctgcccggttgggaagctttccagccatgggcaattgtgtccatggcagttgctgcttctgtgttagttccagtgtggcagcgcatcaccggttccctgccggtggcaacaggcattgcgttggtgacaacctgcattatcttggcgatgaattccgaagagccctacgctgcaatcgttgcgatgggtattccagcgatgctcgtgctggcttcccgcattgccaagggcgataagtttgcgcttgccggcggcattatttacttgggtgtttcggctactttctatactttgttcaccggtgctatcgcgctttctgcggtcgcggtgtgcatcgtggtggcggctattgtgcagcgctccatcaaaccactgctgtggcttgcagtgctgggtggtggatccattgtcattgcgttgatttcttggggtccttaccttctggcctccatcaacggagcggagcgctctggcgattccgcaacacactacctgcctcttgaaggcacccaattcccggttcctttcttggcatcaagcgttgtgggactgttgtgtcttgttggcctgatctatttggtggtgcgtttccacaacaatgaggtgcgcgcgatgtgggtcggcatcgcagtgttttatgcctggatgggcatgtccatggcgatcacgcttttgggcaacacgttgcttggattccgtcttgatacggtgctggtgcttatttttgccacggctggagtgttgggcattgcagatttccgccttgccagtgtgtatcagctctaccccacccaaatcacagagcgcacggccacccatctgaccaatctaattgtggtcctcgtgctgcttggcggcctctactacgcgcaagatctgccgcagaagaacgcacgagctatcgatctggcctataccgatactgatggctacggcgagcgcgcggatctgtatccggccggagctgcacgttattacaaggacatcaacgatcatctgcttgatcaaggattcgagccttccgaaactgtcgtgctgacagacgaactcgatttcatgtcctactacccttatcgcggataccaagcttttacttcccactacgccaacccgcttggtgagttcggaaacaggaacgcattcatcgaagatctcgcgatccgaagctgggatgagttggctgatcctcaacaattcagcgacgccttgaacacctctccatggacgatccctgaggtgttcatcttccgtggctccatcgatgatcctgacgccggttggaaatacgacgtggctgaagatctgtacccgaacaatccaaacgtgcgcttccgcggcgtgtactttaacccggagtcatttgatcagatgtggcagaccaagcaagtgggacctttcgtggtggtaacgcacaatgagtaattcctcaccaaacgacccaagccctat

SEQ ID NO: 20 - protein, 677 aa, Corynebacterium glutamicum
MINTSEDEGAVVVHEDLNPYGPSRVPEGEVYRPDRLNRKATLVAIVGAAILAFAFALVLWMGLKQTNLPAFGPSNVTRAVASATIAAVLIVTGFLTWLWLRDEHQSNPRWELEDVKPRPKWRTALTYLASYLSPAALVVAVLAIPLSATRLYLDGISVDQGFRTQFLTRMADDIGLSDMNYIDMPTFYPAGWFWLGGRLANLLGLPGWEAFQPWAIVSMAVAASVLVPVWQRITGSLPVATGIALVTTCIILAMNSEEPYAAIVAMGIPAMLVLASRIAKGDKFALAGGIIYLGVSATFYTLFTGAIALSAVAVCIVVAAIVQRSIKPLLWLAVLGGGSIVIALISWGPYLLASINGAERSGDSATHYLPLEGTQFPVPFLASSVVGLLCLVGLIYLVVRFHNNEVRAMWVGIAVFYAWMGMSMAITLLGNTLLGFRLDTVLVLIFATAGVLGIADFRLASVYQLYPTQITERTATHLTNLIVVLVLLGGLYYAQDLPQKNARAIDLAYTDTDGYGERADLYPAGAARYYKDINDHLLDQGFEPSETVVLTDELDFMSYYPYRGYQAFTSHYANPLGEFGNRNAFIEDLAIRSWDELADPQQFSDALNTSPWTIPEVFIFRGSIDDPDAGWKYDVAEDLYPNNPNVRFRGVYFNPESFDQMWQTKQVGPFVVVTHNE

SEQ ID NO: 21 - DNA, 1252 bp, Corynebacterium glutamicum
  CDS (101)..(1222): RXA00489
cagcccgatttcttcattgaaatcgggctgtttctggttgtgtcgcgtatctcgggtaaagtcttcgtcgtatacgaccatttaagggaggcccgtcacaatgcgtgaccacgttgaaatcggtatcggccgtgaggcacgacgcacctacagcttggacgatatttctgtcgtttctagccgccgcacccgttcatccaaagatgtcgacaccacttggcatattgacgcctacaagtttgatctgccgttcatgaatcacccaagtgatgcattggcaagccctgagtttgtcattgaaatgggcaagcagggtggccttggcgtgatcaacgctgagggtctgtggggtcgccatgctgatctcgatgaggcgatcgcaaaggtgattgctgcgtatgaggaaggcgaccaggctgcagccactcgcactcttcaggagctgcacgcagcgccactggatactgagctgctgagtgagcgcattgcgcaggttcgtgattccggtgagatcgttgctgtgcgcgtgtctccacaaaatgttcgtgagatcgcaccaatcgtcatcaaggcaggtgctgatctgctggttatccagggcaccctgatctctgcagagcacgtcaacaccggtggagaggccctgaacctaaaggaattcatcggttctttggatgttcctgtcatcgctggtggcgtgaacgattacaccaccgcgttgcacatgatgcgtaccggtgctgtgggcatcatcgtcggtggcggcgagaacaccaacagcctagcattgggcatggaggtatccatggccactgcgattgctgatgtcgctgcggcacgtcgtgattacctggatgagaccggtggacgttacgtgcacatcattgcagatggaagcattgaaaactccggtgatgtagtcaaggctattgcctgtggcgcagatgctgtggtgctgggttcaccgttggctcgcgctgaagaagctgctggaaagggctacttctggccagcagtggcagcgcaccctcgtttcccacgcggtgtggttactgagtccgtggacttggatgaggcagcaccaagcttggagcagattctgcatggtccgtctacgatgccgtggggtgtggaaaacttcgaaggtggattaaagcgtgcgctggctaagtgtggctacaccgatttgaagagcttccaaaaggtaagcctgcacgttaactaggtgtgtgtactcgcctcttcgcgttgc

SEQ ID NO: 22 - protein, 374 aa, Corynebacterium glutamicum
MRDHVEIGIGREARRTYSLDDISVVSSRRTRSSKDVDTTWHIDAYKFDLPFMNHPSDALASPEFVIEMGKQGGLGVINAEGLWGRHADLDEAIAKVIAAYEEGDQAAATRTLQELHAAPLDTELLSERIAQVRDSGEIVAVRVSPQNVREIAPIVIKAGADLLVIQGTLISAEHVNTGGEALNLKEFIGSLDVPVIAGGVNDYTTALHMMRTGAVGIIVGGGENTNSLALGMEVSMATAIADVAAARRDYLDETGGRYVHIIADGSIENSGDVVKAIACGADAVVLGSPLARAEEAAGKGYFWPAVAAHPRFPRGVVTESVDLDEAAPSLEQILHGPSTMPWGVENFEGGLKRALAKCGYTDLKSFQKVSLHVN

SEQ ID NO: 23 - DNA, 1066 bp, Corynebacterium glutamicum
  CDS (101)..(1036): RXA00552
ccgccaacaaggcagcaaagctcgatccaattgacgccttgcgttatgagtaaaagcctcgtttttaaggtagccacacatcgcactagactgaagaactgtggctacctcaaaaattcttctttattacgcattcaccccgctctctgaccctaaagcggttcagctgtggcagcgtgagctctgcgagtcactgaatcttcgtggccgcatcctgatctccactcacggcatcaatggaaccgtgggcggagatattgatgattgcaaggcgtacattaaaaagacccgcgagtacccaggtttcaaccgcatgcagtttaagtggtccgagggtggcgctgaggatttcccaaagctcagtgtcaaagtccgcgatgagatcgttgccttcggcgctccagatgagctcaaagtggatgaaaacggcgtcgtcggtggcggcgttcacctgaaaccacagcaggtcaatgagcttgtggaagcccgtggcgatgaagttgtgttctttgacggccgcaacgcaatggaagcccagatcggcaagttcaaggacgctgttgtccctgacgtagaaaccactcatgatttcatcgcagaaattgagtctggaaaatacgacgatctcaaagacaagcctgtggtcacctactgcaccggcggaattcgttgtgagatcctgagttcactcatgatcaaccgtggtttcaaagaggtctaccaaatcgatggcggcatcgttcgctacggcgagcagtttggcaacaagggcctgtgggaaggctccctctacgttttcgataagcgcatgcatatggaattcggcgaggattacaaagaggtcggacactgcatccattgcgatactcccaccaacaaatttgagcactgcctcaacgaagatgattgccgcgagctcgtgttgatgtgccctgattgcttcgccaatgttgagacccgtcattgcaagcgcgaacgctgtgcagcaattgctgcggatttcgctgagcaaggaattgatccgctcgttacttcttaaaaagggtatggtggctgggtatgagca

SEQ ID NO: 24 - protein, 312 aa, Corynebacterium glutamicum
VATSKILLYYAFTPLSDPKAVQLWQRELCESLNLRGRILISTHGINGTVGGDIDDCKAYIKKTREYPGFNRMQFKWSEGGAEDFPKLSVKVRDEIVAFGAPDELKVDENGVVGGGVHLKPQQVNELVEARGDEVVFFDGRNAMEAQIGKFKDAVVPDVETTHDFIAEIESGKYDDLKDKPVVTYCTGGIRCEILSSLMINRGFKEVYQIDGGIVRYGEQFGNKGLWEGSLYVFDKRMHMEFGEDYKEVGHCIHCDTPTNKFEHCLNEDDCRELVLMCPDCFANVETRHCKRERCAAIAADFAEQGIDPLVTS

SEQ ID NO: 25 - DNA, 2005 bp, Corynebacterium glutamicum
  CDS (101)..(1975): RXA00579
tggaagactggaccatcgtctaagtttttctttgagttttcatatgtagaaggcatcgtcggcttcggcctggcggtgcttttctcgttgttttgtggttttgtcagaggatgtcatgcgcgttttaattattgataattatgattctttcacgtttaatctcgccacctatgtggaagaggttacgggtcaggcacctgtggtggtgcctaatgatcaagaaatagatgagatgcttttcgacgccgtcatcctctcacctggcccgggccacgccggcgttgcggctgattttggtatctgtgcaggcgtcattgagcgtgcacgcgttccgattttgggtgtgtgtttaggccaccagggcattgcgttggcctatggcggtgatgttgatttggcgcccaggccggtccacggtgaggtttcgcagatcacccatgatggttcaggtttatttgcaggcatccctgaaacgtttgaggcggtgcgttatcactcgatggtggcaacccgcttgccggagtcattgaaagctacagctaccagcgatgatggtttgatcatggcattggcacatgaagtgcttccgcagtggggtgtgcaatttcatccggaatctattggtggacaattcggccatcagatcattaagaacttccttaatttagcgcgcacatatcgctggcaactcacggagaaaactattccgctcagcgttgattcagcagcggtttttgaaacattctttgcccattcctcccatgctttttggctcgatgatgcccaaggaaccagctatcttggtgatgccagcggtcctctcgcacgcacaaaaacccataatgtcggcgagggggatttcttcacctggctaaaggaggatctcgccgccaactcagttgcgcccggtcaaggttttcgtcttggctgggttggttacgttggttatgagcttaaagcggaagctggcgcacgggctgcgcacacttcgagtcttccggatgcgcacctcatttttgccgatcgcgccatcgcagtggaatcggatcaggttcggttgctggcgttgggggagcaggacgagtggtttgaagaaaccatcaagaagctgcataatcttgtcgccccgcggatacctgcgtccggacacctcgctttgcaggttcgagattccaaagatgagtatctcgacaaaattcgcagagcccaggagctgattactcgcggcgaatcgtatgaaatctgcctgaccacaaaacttcagggcaccactgatgtggcccctctggctgcctatctagcactgcgtggggccaatcccaccgcatatggtgcgtatcttcagctgggggatacctctattttgagttcctcgccggagcggttcatcaccattgattcggcagggtatgtggaatcaaagcccattaaaggcaccaggccgcgtgggcgaacagcgcaagaagaccaagaaatcattgctgagctgcgcagtaatcctaaagatcgtgcagaaaacttgatgatcgtggatttggtccgcaacgacttagcccgcggcgctttgcccaccacagttaaaacatccaagcttttcgacgtcgaaacctacgccacagtccaccaacttgtcagcaccgtctctgcagagttggggccacgcagtccgattgagtgcgtgcgcgcagcattccccggtggttcgatgactggtgccccaaagctgcgcaccatggagatcatcgatgagctggaggcagctcctcgcggtatttactcaggtggcttgggatatttttccctcgacggcgcagttgatctctccatggtgatcagaactctcgtcatccagaacaatcacgtggagtacggagtgggcggtgcacttcttgctctgtctgatccggaggctgagtgggaggaaatccgcgttaaatcacggcctctgctgaatttgtttggggttgaattcccatgacgtacctcgtgtgggacggtgcaacac

SEQ ID NO: 26 - protein, 625 aa, Corynebacterium glutamicum
LSEDVMRVLIIDNYDSFTFNLATYVEEVTGQAPVVVPNDQEIDEMLFDAVILSPGPGHAGVAADFGICAGVIERARVPILGVCLGHQGIALAYGGDVDLAPRPVHGEVSQITHDGSGLFAGIPETFEAVRYHSMVATRLPESLKATATSDDGLIMALAHEVLPQWGVQFHPESIGGQFGHQIIKNFLNLARTYRWQLTEKTIPLSVDSAAVFETFFAHSSHAFWLDDAQGTSYLGDASGPLARTKTHNVGEGDFFTWLKEDLAANSVAPGQGFRLGWVGYVGYELKAEAGARAAHTSSLPDAHLIFADRAIAVESDQVRLLALGEQDEWFEETIKKLHNLVAPRIPASGHLALQVRDSKDEYLDKIRRAQELITRGESYEICLTTKLQGTTDVAPLAAYLALRGANPTAYGAYLQLGDTSILSSSPERFITIDSAGYVESKPIKGTRPRGRTAQEDQEIIAELRSNPKDRAENLMIVDLVRNDLARGALPTTVKTSKLFDVETYATVHQLVSTVSAELGPRSPIECVRAAFPGGSMTGAPKLRTMEIIDELEAAPRGIYSGGLGYFSLDGAVDLSMVIRTLVIQNNHVEYGVGGALLALSDPEAEWEEIRVKSRPLLNLFGVEFP

SEQ ID NO: 27 - DNA, 1120 bp, Corynebacterium glutamicum
  CDS (101)..(1090): RXA00620
gcttattagctgtacggctccaaggttctcttaatctttgttcgaataaactgccagcttaaaaatgtcttttaggtaaacaaaaaattcgggcgaatgggtgatccatgtcaggaagccagcggtgaaaccggcagtgaaaccagcggtgaatgctaaaattttccgaacacacccgaggggtctagacttgcctaacatgcgtcctgaactctcccagtacaagcacctgtcggcaggcaaggtccgtgagatctacgagatcgacgacaagcacatcctcatggtggcttccgatcgtatctctgcatacgatttcatcctcgataccgaaattccagacaagggtcgagtgctcactgcgatgagccagttcttcttcgacaccatcgattttcctaatcaccttgcaggtcccgctgatgatccacgtatcccagaagaagttttgggacgagcaatggtgtgcaagaagctcaacatgcttccttttgaatgcgtggttcgtggatacctcactggctctggacttgttgaatacaagcagaccagctccgtgtgtggagttgagctcccagaaggcctcgttgaatcttctcagctgcctgagccaatctttaccccagccaccaaggctgacatcggcgaccacgacatcaatgtctcctttgacgttgttgaagaacgtctcggcgaagctcgtgcgaaccagttgcgcgatgcctctattgctatttacaaggctgctgctgagatcgcccgtgaccgtggcgtcatccttgccgacaccaaatttgagttcggcatcgatgaagatggcaccctcgtgcttggtgatgaagtccttaccccagattcctcccgctactggcctttggaaggctatgaagcaggatctgtgcaaccaagctttgataagcaattcgtgcgcaactggctcaccggccctaaatctggctgggacaaggattccggcttggagccaccagctctgccaggttccgttgttgaggcaacccgcgagcgctacatcgaggcctacgagctgatttctggtcagaagttctgccagtggattggttcttgcgtctaagctgcttgattttccctaaaccccgga

SEQ ID NO: 28 - protein, 330 aa, Corynebacterium glutamicum
VIHVRKPAVKPAVKPAVNAKIFRTHPRGLDLPNMRPELSQYKHLSAGKVREIYEIDDKHILMVASDRISAYDFILDTEIPDKGRVLTAMSQFFFDTIDFPNHLAGPADDPRIPEEVLGRAMVCKKLNMLPFECVVRGYLTGSGLVEYKQTSSVCGVELPEGLVESSQLPEPIFTPATKADIGDHDINVSFDVVEERLGEARANQLRDASIAIYKAAAEIARDRGVILADTKFEFGIDEDGTLVLGDEVLTPDSSRYWPLEGYEAGSVQPSFDKQFVRNWLTGPKSGWDKDSGLEPPALPGSVVEATRERYIEAYELISGQKFCQWIGSCV

SEQ ID NO: 29 - DNA, 1159 bp, Corynebacterium glutamicum
  CDS (101)..(1129): RXA00636
tcatgggattcagcaaggcggccacccgaaccgtctttggtggaggagtaggagcgatgatcgatctggcccgttcgaacataaggaatattcctactccatgatgattgatacacctgctgttctcattgaccgcgagcgcttaactgccaacatttccaggatggcagctcacgccggtgcccatgagattgccctgcgtccgcatgtgaaaacgcacaaaatcattgaaattgcgcagatgcaggtcgacgccggtgcccgagggatcacctgcgcaaccattggcgaggcggaaatttttgccggcgcaggttttacggacatctttattgcatatccgctgtatctaaccgatcatgcagtgcaacgcctgaacgcgatccccggagaaatttccattggcgtggattcggtagagatggcacaggcgacggcgggtttgcgggaagatatcaaggctctgattgaagtggattcgggacatcgtagaagtggagtcacggcgactgcttcagaattgagtcagatccgcgaggcgctgggcagcaggtatgcaggagtgtttacttttcctgggcattcttatggcccgggaaatggtgagcaggcagcagctgatgagcttcaggctctaaacaacagcgtccagcgacttgctggcggcctgacttctggcggttcctcgccgtctgcgcagtttacagacgcaatcgatgagatgcgaccaggcgtgtatgtgtttaacgattcccagcagatcacctcgggagcatgcactgagaagcaggtggcaatgacggtgctgtctactgtggtcagccgaaatgtgtcagatcgtcggatcattttggatgcgggatccaaaatcctcagcactgataaaccagcatggattgatggcaatggttttgttctggggaatcctgaagcccgaatctctgctttgtcggagcatcacgcaaccattttctggccagataaagtgctacttccagtaatcggggagcagctcaacatcgtgcccaaccatgcctgcaacgtgattaatttggtggatgaggtctacgttcgggaagccgatggcactttccgtacctggaaggtagttgcccgcggcagaaacaattagggaaacctcttgaccttcacgcgacgt

SEQ ID NO: 30 - protein, 343 aa, Corynebacterium glutamicum
MMIDTPAVLIDRERLTANISRMAAHAGAHEIALRPHVKTHKIIEIAQMQVDAGARGITCATIGEAEIFAGAGFTDIFIAYPLYLTDHAVQRLNAIPGEISIGVDSVEMAQATAGLREDIKALIEVDSGHRRSGVTATASELSQIREALGSRYAGVFTFPGHSYGPGNGEQAAADELQALNNSVQRLAGGLTSGGSSPSAQFTDAIDEMRPGVYVFNDSQQITSGACTEKQVAMTVLSTVVSRNVSDRRIILDAGSKILSTDKPAWIDGNGFVLGNPEARISALSEHHATIFWPDKVLLPVIGEQLNIVPNHACNVINLVDEVYVREADGTFRTWKVVARGRNN

SEQ ID NO: 31 - DNA, 937 bp, Corynebacterium glutamicum
  CDS (101)..(907): RXA00708
cctgcgtatcggctgcctttttgaattcttttcctcctcgaggcctaaccttcaattccttaccgatccccttccctgaagtttcgctaacctggcgtacatgactctttcccttcctccaattggtttcggcaccgttcatcttgatggcgcacctggcgttgaagccatcgctactgccattgatgctggttaccgcctcatcgacaccgcgtacaactatgaaaatgaaggtaccgtgggcaaggctgtccgcgagtcgggtgtcccccgcgaggaattgattgttaccagtaagctccctggccgcttccatgctcgcgatctaggacgcgtccgcattgaggaaagtctataccgcctcaacttagattacatcgatctcctcttgattcactggcctaatcccagcaaggatctctacgtcgaggcgtgggaaacgctgattgaagtccgcgatgctggcctggtcaagcacatcggagtgtctaacttccttccaaatcacattgatcgcctgcgccgcgaaaccggtgaactgccggccgttaaccagatcgagttgcacccctatttcccgcaggtggagcaggtagatttccacgatgagctgggcatcattaccgaggcctggagcccgctcagcaacggtcgcggactcgtcgaagagccattgctcaaggaaatcggcgagcgctacggggtcggcagcggcgaaatcgccctcgcttggcatcacgccaggggaatcgttccgattccacgctccaccaacccggccaggcagcgcagcaacttggaggcggtaaagatttcgcttatcgacgaagacgtccaggcgattaccgctttggcgcgcaaaaacggccggatcaaagatcaagatccagccgtctatgaagaattctagatagttacatcaaggttccgaggaggc

SEQ ID NO: 32 - protein, 269 aa, Corynebacterium glutamicum
MTLSLPPIGFGTVHLDGAPGVEAIATAIDAGYRLIDTAYNYENEGTVGKAVRESGVPREELIVTSKLPGRFHARDLGRVRIEESLYRLNLDYIDLLLIHWPNPSKDLYVEAWETLIEVRDAGLVKHIGVSNFLPNHIDRLRRETGELPAVNQIELHPYFPQVEQVDFHDELGIITEAWSPLSNGRGLVEEPLLKEIGERYGVGSGEIALAWHHARGIVPIPRSTNPARQRSNLEAVKISLIDEDVQAITALARKNGRIKDQDPAVYEEF

SEQ ID NO: 33 - DNA, 1132 bp, Corynebacterium glutamicum
  CDS (101)..(1102): RXA00727
tagctgtttattttaaagtccctcccgagcccatgccggataaaacaaaacccgagcgcctgccaacgcaaaatccagcctcacttaaggttattgcaccatggcaggtagtattttgcccatgattgagagtttcacccgattgcgaatttcgcagacaccgcctctgaaacggctactgcatagcactttgcgtttccccaaaatccccaagcgcgctgtagcggcgaccgtcggcatcgtggcaacctcattcaccttggcttcttgtgtcaccaatgaggagcagggcaacccagatggctgggagcagatcgttccagatcctgtaccggagattcaggcgatggttcccgaagctctggctcagcgcggtgtgctcaccgccggtgccaacccacctttcccaccgtttgagtttaaagattccgatggtcagattatcggtgtggaaatggacctcgtgcgtgcaatggcgggggtgatgggcttggagttcagccctcaggagcaggatttctccctcatccttccatcggttcaagctggcacccttgatatcggagcctctggcttcactgacaacgaggaacgccgcgagaactttgatttcatcgatttcctcttcgcaggtgtgcagtgggcgcaggcaactgatcgtgaaaccccaatcgatccggaaaacgcctgtggtctcaccgttgctgtacagcgcacaaccgtggcagagaccgacgatgtccgtcctcgctcagctcaatgtgaagccgaaggcaaagagccgatcaccattttgtcttatgaaaccgcagatactgcagctaccgcattgatcctgggacgcgcagacgcacttgctgcggactcccctgtttcagcttgggctgcagagcgctccgaaggccgcatcgaagttgtgggcgatatgtacttggctgcgccatttggtttcgcattcccgttggaatctgacctcaccccagcagcagctgcggcgttccaacacttgattgacaccggcgattaccagcgcatcatggcgcaatggggcattgaagaaggccttcttgatgaggccctgatcaacgaacagccactcaactagagccttccagcaactaaaaacaattaa

SEQ ID NO: 34 - protein, 334 aa, Corynebacterium glutamicum
MAGSILPMIESFTRLRISQTPPLKRLLHSTLRFPKIPKRAVAATVGIVATSFTLASCVTNEEQGNPDGWEQIVPDPVPEIQAMVPEALAQRGVLTAGANPPFPPFEFKDSDGQIIGVEMDLVRAMAGVMGLEFSPQEQDFSLILPSVQAGTLDIGASGFTDNEERRENFDFIDFLFAGVQWAQATDRETPIDPENACGLTVAVQRTTVAETDDVRPRSAQCEAEGKEPITILSYETADTAATALILGRADALAADSPVSAWAAERSEGRIEVVGDMYLAAPFGFAFPLESDLTPAAAAAFQHLIDTGDYQRIMAQWGIEEGLLDEALINEQPLN

SEQ ID NO: 35 - DNA, 2389 bp, Corynebacterium glutamicum
  CDS (101)..(2359): RXA00867
agagaactggtaaggtttttaccgttctagaccgcagaaatcttcgcggcgacaccgatgatcgccgagcagaactaaacatgaggagacctactcgcatatgagcgatgtaaagtacttcgaagacaccgaatttggcctgatcgaggccgtcgcaaccatcgacaacggtgacttcggaacccgcaccatccgttttgaaaccggccaacttgcccgccaggcagatggtgcagtgaccacctacctcgacgatgacacgatgctgctggcaaccaccaccgcatccaaccagccacgcgagggctttgacttcttcccactgaccgtggacgttgaagagcgtatgtacgcagctggtcgcatccctggctctttcttccgtcgggagggtcgcccatccaccgaagctatcctggcttgccgtctcatcgaccgcccactgcgcccaacctttgttaagggcctgcgcaatgaggttcagatcgttgtcaccgtcatgtccatgaaccctgaggattactacgatgtcgtagcaatcaacggagcttccgcagcaacccgcatctccggacttcctgtctccggcgctgtcggtggcgttcgcatggcactggttgttgatgaaaagcacccagaaggccaatgggttgcattcccaacccacgctcaacatgagcagtccgtatttgaaatcgttgtggctggtcgcctcgtcgagcgcaagcgcggcaacaagaccttctccgacgtcgcagtgatgatggtggaagctggcgcttccgaaaacgttgtcaaccgcgtcaaggacggtgcaccagcaccaaccgaaaagatcgtctccgacggccttgaagcagctaagccattcatcgacatcctgtgccgcgcacaggaaggtctggcacagcgcgttggaaacgcagccaaggaattcccactgttccctccatacaccgacgaggtgtactccgcagtggagcgcaaggtatccaagaagctagcttctttgctgaccctgaaggcaaagcaagagcgcgacgacgctaccaacgcctacatggaagaaatcgaagccgaactgcttccaaagttcgaggcttcctacagctcagcagctgaagcgtccaaggaaatccgtgcaggatacaacgctgtcatgaaggccatcgtgcgccgcatgatcctcaccgatcacttccgcatcgacggccgcggagtcaccgacatccgtgacctggcagtagaagttgagctcatcccacgtgcgcacggttcctccctcttcgagcgtggcgagacccagatccttggtgtcaccaccctggacatgctcaagatggaacagcaaatcgactccctggcaccaggcgatgcgaagcgctacatgcaccactacaacttccctccatactccaccggtgaaaccggtcgtgtgggctcaccaaagcgccgcgaaatcggccacggtgcacttgcagaacgcgcagttttgccagtaatcccatcccgtgaggaattcccatacgcaatccgtcaggtctctgaagctctgggctccaacggctccacctccatgggctctgtctgtgcatccactctgtccctgtacaacgctggtgttccactgaaggcacctgttgcaggtatcgccatgggacttgtttccggtgaaatcgacggcaagaccgagtacgttgcactgaccgacatcctcggcgcagaagacgcattcggcgacatggacttcaaggttgccggcaccgcagacttcatcaccgcacttcagctggacaccaagctggacggcattccttccaaggtgctctccgatgcgcttgagcaggcacgcgatgcccgactgaccatcctgaacaccatggctgatgtcatcaacggacctgatgagatgagcaagttcgctcctcgcatcaccaccgtgaagatcccagtggcaaagatcggtgagctgatcggaccaaagggtaagaacatcaacgctcttaccgaagagaccggcgcaaacatctccatcgaagatgacggcaccgtgttcatctctgcagctgacggcgcatctgctgaagcggcgatcgaaaagatcaacgctctggcgaacccacagctgccaaaggttggcgagcgcttcctcggaaccgtcgtcaagaccaccgcattcggagcattcgtttccttgctcccaggccgcgacggccttgttcacatctccaagctgggtaacggcaagcgagtagaaaaggtcgacgatgtggtgaaggttggcgagaagattcaggtcgaaatcgctgacatcgacaaccgcggcaagatctccttggtcccagttgttgaagaggactaattagttctggctagatcgggctagatc

SEQ ID NO: 36 - protein, 753 aa, Corynebacterium glutamicum
MSDVKYFEDTEFGLIEAVATIDNGDFGTRTIRFETGQLARQADGAVTTYLDDDTMLLATTTASNQPREGFDFFPLTVDVEERMYAAGRIPGSFFRREGRPSTEAILACRLIDRPLRPTFVKGLRNEVQIVVTVMSMNPEDYYDVVAINGASAATRISGLPVSGAVGGVRMALVVDEKHPEGQWVAFPTHAQHEQSVFEIVVAGRLVERKRGNKTFSDVAVMMVEAGASENVVNRVKDGAPAPTEKIVSDGLEAAKPFIDILCRAQEGLAQRVGNAAKEFPLFPPYTDEVYSAVERKVSKKLASLLTLKAKQERDDATNAYMEEIEAELLPKFEASYSSAAEASKEIRAGYNAVMKAIVRRMILTDHFRIDGRGVTDIRDLAVEVELIPRAHGSSLFERGETQILGVTTLDMLKMEQQIDSLAPGDAKRYMHHYNFPPYSTGETGRVGSPKRREIGHGALAERAVLPVIPSREEFPYAIRQVSEALGSNGSTSMGSVCASTLSLYNAGVPLKAPVAGIAMGLVSGEIDGKTEYVALTDILGAEDAFGDMDFKVAGTADFITALQLDTKLDGIPSKVLSDALEQARDARLTILNTMADVINGPDEMSKFAPRITTVKIPVAKIGELIGPKGKNINALTEETGANISIEDDGTVFISAADGASAEAAIEKINALANPQLPKVGERFLGTVVKTTAFGAFVSLLPGRDGLVHISKLGNGKRVEKVDDVVKVGEKIQVEIADIDNRGKISLVPVVEED

SEQ ID NO: 37 - DNA, 1624 bp, Corynebacterium glutamicum
  CDS (101)..(1594): RXA00955
gcacaccgtgatgcgttggctgcgtccgcaggtgcgatgttctacctcaacggcgatgtcgactccttgaaagatggtgcacaaaaggcgctttccttgcttgccgacggcaccacccaggcatggttggccaagcacgaagagatcgattactcagaaaaggagtcttccaatgactagtaataatctgcccacagtgttggaaagcatcgtcgagggtcgtcgcggacacctggaggaaattcgcgctcgcatcgctcacgtggatgtggatgcgcttccaaaatccacccgttctctgtttgattccctcaaccagggtaggggaggggcgcgtttcatcatggagtgcaagtccgcatcgccttctttgggaatgattcgtgagcactaccagccgggtgaaatcgctcgcgtgtactctcgctacgccagcggcatttccgtgctgtgcgagccggatcgttttggtggcgattacgatcacctcgctaccgttgccgctacctctcatcttccggtgctgtgcaaagacttcatcattgatcctgtccaggtacacgcggcgcgttactttggtgctgatgccatcctgctcatgctctctgtgcttgatgatgaagagtacgcagcactcgctgccgaggctgcgcgttttgatctggatatcctcaccgaggttattgatgaggaggaagtcgcccgcgccatcaagctgggtgcgaagatctttggcgtcaaccaccgcaacctgcatgatctgtccattgatttggatcgttcacgtcgcctgtccaagctcattccagcagatgccgtgctcgtgtctgagtctggcgtgcgcgataccgaaaccgtccgccagctaggtgggcactccaatgcattcctcgttggctcccagctgaccagccaggaaaacgtcgatctggcagcccgcgaattagtctacggccccaacaaagtctgcggactcacctcaccaagtgcagcacaaaccgctcgcgcagcgggtgcggtctacggcgggctcatcttcgaagaggcatcgccacgcaatgtttcacgtgaaacattgcaaaaaatcatcgccgcagagcccaacctgcgctacgtcgcggtcagccgtcgcacctccgggtacaaggatttgcttgtcgacggcatcttcgccgtacaaatccacgccccactgcaggacagcgtcgaagcagaaaaggcattgatcgccgccgttcgtgaagaggttggaccgcaggtccaggtctggcgcgcgatctcgatgtccagccccttgggggctgaagtggcagctgcggtggagggtgacgtcgataagctaattcttgatgcccatgaaggtggcagcggggaagtattcgactgggctacggtgccggccgctgtgaaggcaaagtctttgctcgcgggaggcatctctccggacaacgctgcgcaggcactcgctgtgggctgcgcaggtttggacatcaactctggcgtggaataccccgccggtgcaggcacgtgggctggggcgaaagacgccggcgcgctgctgaaaattttagcgaccatctccacattccattactaaaggtttaaataggatcatgactgaaaa

SEQ ID NO: 38 - protein, 498 aa, Corynebacterium glutamicum
LPTAPPRHGWPSTKRSITQKRSLPMTSNNLPTVLESIVEGRRGHLEEIRARIAHVDVDALPKSTRSLFDSLNQGRGGARFIMECKSASPSLGMIREHYQPGEIARVYSRYASGISVLCEPDRFGGDYDHLATVAATSHLPVLCKDFIIDPVQVHAARYFGADAILLMLSVLDDEEYAALAAEAARFDLDILTEVIDEEEVARAIKLGAKIFGVNHRNLHDLSIDLDRSRRLSKLIPADAVLVSESGVRDTETVRQLGGHSNAFLVGSQLTSQENVDLAARELVYGPNKVCGLTSPSAAQTARAAGAVYGGLIFEEASPRNVSRETLQKIIAAEPNLRYVAVSRRTSGYKDLLVDGIFAVQIHAPLQDSVEAEKALIAAVREEVGPQVQVWRAISMSSPLGAEVAAAVEGDVDKLILDAHEGGSGEVFDWATVPAAVKAKSLLAGGISPDNAAQALAVGCAGLDINSGVEYPAGAGTWAGAKDAGALLKILATISTFHY

SEQ ID NO: 39 - DNA, 1684 bp, Corynebacterium glutamicum
  CDS (101)..(1654): RXA00957
aaccggcaagccctggatcgaatgaagctcgcagcgagtaattatttgatgtttcccagaaaggcttcagccccacaatgatttcctcggtaggtgccccatgagcacgaatccccatgttttctccctagatgtccgctatcacgaggatgcttctgcattgtttgcccacttgggtggcacaaccgcagatgatgcagccctgttggaaagcgctgatatcaccaccaagaatggtatttcttccctcgcggtgttgaagagttcggtgcgcattacgtgcacgggcaacacggtggtaacgcagccgctgacggactcgggtagggcagtggttgcgcgcctaacgcagcagcttggccagtacaacaccgcagagaacacctttagcttccccgcctcagatgcggttgatgagcgcgagcgcctcaccgcaccaagcaccatcgaagtgctgcgcaagttgcagttcgagtccggctacagcgacgcgtccctgccactgctcatgggcggtttcgcgtttgatttcttagaaacctttgaaacgctccccgctgtcgaggagagcgtcaacacttaccccgattaccagttcgtcctcgcggaaatcgtcctggacatcaatcaccaggaccagaccgccaaactcgccggcgtctccaacgccccaggcgagctcgaggccgagctcaacaagctttcattgcttatcgacgccgccctccccgcaaccgaacacgcctaccaaaccacccctcacgacggcgacactcttcgcgttgtggctgatattcccgatgctcagttccgcacccagatcaatgagctgaaagaaaacatttacaacggtgacatctaccaagttgtcccggcgcgcactttcaccgcaccatgtcctgatgcattcgctgcttatctgcagctgcgtgccaccaacccgtcgccgtacatgttctatatccgtggcctcaacgaaggccgctcctatgaactttttggcgcatcccctgagtccaacctcaagttcaccgctgctaaccgtgagctgcagctgtacccaatcgcaggtacccgcccccgtggactcaacccagatggctccatcaacgatgagctagatatccgcaatgagttggatatgcgcactgatgccaaagagatcgcggagcacaccatgcttgtcgatctcgcccgcaacgacctggcccgcgtctcggtcccagcgtcgcgccgggttgcggatcttttgcaggtggatcgctattcccgcgtgatgcacttggtgtcccgtgtgacggcgacgttggacccagagcttgatgctttggacgcctatcgggcgtgcatgaatatgggcacgttgaccggcgctccgaagttgcgcgctatggagctgttgcgcggcgtcgaaaagcgcaggcgtggttcttatggtggggcagtggggtacctgcgcggcaatggcgatatggataattgcattgttattcgttcggcgtttgtccaggatggtgtggctgctgtgcaggctggtgctggtgtggtccgcgattctaatcctcaatctgaagccgatgagacgttgcacaaggcgtatgccgtgttgaatgccattgcgcttgctgctggttccactttggaggtcatccgatgacacacgttgttctcattgataatcacg

SEQ ID NO: 40 - protein, 518 aa, Corynebacterium glutamicum
MSTNPHVFSLDVRYHEDASALFAHLGGTTADDAALLESADITTKNGISSLAVLKSSVRITCTGNTVVTQPLTDSGRAVVARLTQQLGQYNTAENTFSFPASDAVDERERLTAPSTIEVLRKLQFESGYSDASLPLLMGGFAFDFLETFETLPAVEESVNTYPDYQFVLAEIVLDINHQDQTAKLAGVSNAPGELEAELNKLSLLIDAALPATEHAYQTTPHDGDTLRVVADIPDAQFRTQINELKENIYNGDIYQVVPARTFTAPCPDAFAAYLQLRATNPSPYMFYIRGLNEGRSYELFGASPESNLKFTAANRELQLYPIAGTRPRGLNPDGSINDELDIRNELDMRTDAKEIAEHTMLVDLARNDLARVSVPASRRVADLLQVDRYSRVMHLVSRVTATLDPELDALDAYRACMNMGTLTGAPKLRAMELLRGVEKRRRGSYGGAVGYLRGNGDMDNCIVIRSAFVQDGVAAVQAGAGVVRDSNPQSEADETLHKAYAVLNAIALAAGSTLEVIR

SEQ ID NO: 41 - DNA, 1057 bp, Corynebacterium glutamicum
  CDS (101)..(1027): RXA00970
gaatctgatctttcccgcaccgttgaactgctgaaggctaagcctgttgttaaggcaatcaacagtgtgatccgcctcgaaagggactaattttactgacatggcaattgaactgaacgtcggtcgtaaggttaccgtcacggtacctggatcttctgcaaacctcggacctggctttgacactttaggtttggcactgtcggtatacgacactgtcgaagtggaaattattccatctggcttggaagtggaagtttttggcgaaggccaaggcgaagtccctcttgatggctcccacctggtggttaaagctattcgtgctggcctgaaggcagctgacgctgaagttcctggattgcgagtggtgtgccacaacaacattccgcagtctcgtggtcttggctcctctgctgcagcggcggttgctggtgttgctgcagctaatggtttggcggatttcccgctgactcaagagcagattgttcagttgtcctctgcctttgaaggccacccagataatgctgcggcttctgtgctgggtggagcagtggtgtcgtggacaaatctgtctatcgacggcaagagccagccacagtatgctgctgtaccacttgaggtgcaggacaatattcgtgcgactgcgctggttcctaatttccacgcatccaccgaagctgtgcgccgagtccttcccactgaagtcactcacatcgatgcgcgatttaacgtgtcccgcgttgcagtgatgatcgttgcgttgcagcagcgtcctgatttgctgtgggagggtactcgtgaccgtctgcaccagccttatcgtgcagaagtgttgcctattacctctgagtgggtaaaccgcctgcgcaaccgtggctacgcggcatacctttccggtgccggcccaaccgccatggtgctgtccactgagccaattccagacaaggttttggaagatgctcgtgagtctggcattaaggtgcttgagcttgaggttgcgggaccagtcaaggttgaagttaaccaaccttaggcccaacaaggaaggcccccttcgaat

SEQ ID NO: 42 - protein, 309 aa, Corynebacterium glutamicum
MAIELNVGRKVTVTVPGSSANLGPGFDTLGLALSVYDTVEVEIIPSGLEVEVFGEGQGEVPLDGSHLVVKAIRAGLKAADAEVPGLRVVCHNNIPQSRGLGSSAAAAVAGVAAANGLADFPLTQEQIVQLSSAFEGHPDNAAASVLGGAVVSWTNLSIDGKSQPQYAAVPLEVQDNIRATALVPNFHASTEAVRRVLPTEVTHIDARFNVSRVAVMIVALQQRPDLLWEGTRDRLHQPYRAEVLPITSEWVNRLRNRGYAAYLSGAGPTAMVLSTEPIPDKVLEDARESGIKVLELEVAGPVKVEVNQP

SEQ ID NO: 43 - DNA, 793 bp, Corynebacterium glutamicum
  CDS (101)..(763): RXA00997
acaacaacaccgacttcatttctgctgtgagctccggtgtcatcgtggccgaagcaacgccgattcagctaggtggccgcacccatctgtggcagatcgaatgcacccaccgcggagaagtcgtcgcacgaaccacactgcgcaccatggtgctgaacaagtagccctatactcgggcaccatgactacatggaaagagctcacagataacaacccagcgcactcagaaaactacgcgcagcgctggcgaaacctcgccgcagcaggcaatgatatttacggcgaagcccgcctcattgatgccatggcacccaggggagcgaaaatcttggatgctggctgcggccagggacgcatcggtggctacctgtccaagcaaggccacgatgttctaggcacagaccttgatcccatcctgattgattacgccaagcaggactttccagaagctcgctgggtggtgggagatctctctgttgatcagatctcagagactgattttgatctcattgtctccgccggcaacgtcatgggctttctcgctgaggatggtcgcgaacctgcactagccaacattcaccgcgcactgggcgccgatggccgcgctgtcatcggtttcggcgcaggacgtggatgggtctttggagacttcctcgaagtcgcagaacgcgtgggcctcgagttggaaaatgcttttgagtcttgggatcttaagccttttgtccaaggctctgagttcttagtggcggtatttaccaagaagtaacacctctatcttgcacctgatctggcg

SEQ ID NO: 44 - protein, 221 aa, Corynebacterium glutamicum
MHPPRRSRRTNHTAHHGAEQVALYSGTMTTWKELTDNNPAHSENYAQRWRNLAAAGNDIYGEARLIDAMAPRGAKILDAGCGQGRIGGYLSKQGHDVLGTDLDPILIDYAKQDFPEARWVVGDLSVDQISETDFDLIVSAGNVMGFLAEDGREPALANIHRALGADGRAVIGFGAGRGWVFGDFLEVAERVGLELENAFESWDLKPFVQGSEFLVAVFTKK

SEQ ID NO: 45 - DNA, 931 bp, Corynebacterium glutamicum
  CDS (101)..(901): RXA01095
aagactcagaaatccaaagaaaccccaggtcaaagctagggtgtggcaccctgatttctttcgccatgtgtgttcgggataaccttaaacacagcattggttggaaggaggttggggcatggttgcaacagagaaccgcatgttgatggaaatcgctgcggaaatatcggctcgggaagcaacgcttggttttcaagaagtcaaaactaaatctcgatcagcaggtctcacggcggctttcgatattgcttcagtctttttttcgtctggatgtaatgtcgtagtcgcctttgatcgttttgcatccaattggtctgatcattcggatcatgtggactacgctgcacaggttgcgggttttggcgcatcaatgcttgcatatacggtgcgcaggggacagtttgataccgcagtacgcgatatcagggacatcaaatctgaagtagacattcccattctgcttcatgatcccatcatcgatccgtatcaaatccacgaagcccgcgtcatgggcatcgacgctcttcaattccccgtatgggcgatggaacaagctcgactggaatctttggtggaccgcaccgaatcattgggcatgacagccatcgtgtctgtgcgaaaccacgaagaagcgcatcgtgcagtggacgcaggagcgacagtggtagcaattgatattactggttataccggctcactcactttgcctgaagcgttttcgggtatcacccaattcatgcccaaagaggtagcccgcattgtgctcggaggttgcagcagccctaaagaactcatgcggtttgcacgacattctgcagacgccatctttgttccacatgcagacctcgccaccacaaaatctcttgtgacagcaggtatgcatccagcgtgcccatcgcgttgaagaggtgctctgtggtcagctgaccgg

SEQ ID NO: 46 - protein, 267 aa, Corynebacterium glutamicum
LEGGWGMVATENRMLMEIAAEISAREATLGFQEVKTKSRSAGLTAAFDIASVFFSSGCNVVVAFDRFASNWSDHSDHVDYAAQVAGFGASMLAYTVRRGQFDTAVRDIRDIKSEVDIPILLHDPIIDPYQIHEARVMGIDALQFPVWAMEQARLESLVDRTESLGMTAIVSVRNHEEAHRAVDAGATVVAIDITGYTGSLTLPEAFSGITQFMPKEVARIVLGGCSSPKELMRFARHSADAIFVPHADLATTKSLVTAGMHPACPSR

SEQ ID NO: 47 - DNA, 1228 bp, Corynebacterium glutamicum
  CDS (101)..(1198): RXA01105
ttgtcatcaactttgccaacgccgaagatcttccagcgcacggcgaagcaatccgtgcacgctttgaaaacctccccaccaccgacgaggcctaagaaaaatgaccaaaattactttgagcgatttgccattgcgtgaagaactgcgcggtgagcacgcttacggcgcaccccagctcaacgttgatattcgcctcaacaccaacgaaaacccttacccaccgtcagaggcattggtcgctgacttggttgccaccgtggataagatcgccaccgagctgaaccgctacccagagcgcgatgctgtggaactgcgtgatgagttggctgcgtacatcaccaagcaaaccggcgtggctgtcaccagggataacctgtgggctgccaatggttccaatgaaattctgcagcagctgctgcaggcttttggtggacctggacgcaccgcgttgggattccaacccagctattccatgcacccaattttggctaaaggcacccacactgaattcattgcggtgtcccgaggtgctgatttccgcatcgatatggatgtggcgctggaagaaattcgtgcaaagcagcctgacattgtttttgtcaccaccccgaacaacccgaccggtgatgtgacctcgctggacgatgttgagcgcatcatcaacgttgccccaggcatcgtgatcgtggatgaagcttatgcggaattctccccatcaccttcagcaaccactcttctggagaagtacccaaccaagctggtggtgtcccgcaccatgagtaaggcttttgatttcgcaggtggacgcctcggctacttcgtggccaacccagcgtttatcgacgccgtgatgctagtccgccttccgtatcatctttcagcgctgagccaagcagccgcaatcgtagcgctgcgtcactccgctgacacgctgggaaccgtcgaaaagctctctgtagagcgtgttcgcgtggcagcacgcttggaggaactgggctacgctgtggttccaagtgagtccaactttgtgttctttggagatttctccgatcagcacgcggcatggcaggcatttttggataggggagtgctcatccgcgatgtgggaatcgctgggcacttgcgcactaccattggtgtgcctgaggaaaatgatgcgtttttggacgcagctgcagagatcatcaagctgaacctgtaagagagaagaatttttcatgactgtcgc

SEQ ID NO: 48 - protein, 366 aa, Corynebacterium glutamicum
MTKITLSDLPLREELRGEHAYGAPQLNVDIRLNTNENPYPPSEALVADLVATVDKIATELNRYPERDAVELRDELAAYITKQTGVAVTRDNLWAANGSNEILQQLLQAFGGPGRTALGFQPSYSMHPILAKGTHTEFIAVSRGADFRIDMDVALEEIRAKQPDIVFVTTPNNPTGDVTSLDDVERIINVAPGIVIVDEAYAEFSPSPSATTLLEKYPTKLVVSRTMSKAFDFAGGRLGYFVANPAFIDAVMLVRLPYHLSALSQAAAIVALRHSADTLGTVEKLSVERVRVAARLEELGYAVVPSESNFVFFGDFSDQHAAWQAFLDRGVLIRDVGIAGHLRTTIGVPEENDAFLDAAAEIIKLNL

SEQ ID NO: 49 - DNA, 883 bp, Corynebacterium glutamicum
  CDS (101)..(853): RXA01115
ctcaccgcatgcagcgtgaaaacactcagtacggactggccaccatgtgcatcggtggcggccagggtcttgcagctgtctttgaaaaggagaactaaaaatggctattttgcacagcgtttcctacggaacttccgacaacaccttggtgttcattggctcgttgggttccaccaccgacatgtggctgccacagctggatgccttgcataaggatttccgcgtcatcgctgttgatcaccgcggacatggtctgtctgaactcatcgaaggcacccccactgtggcggatctggcgcaggatgtgctggataccctcgatgacctgggtgtcggaaacttcggcgtcatcggactatctctcggcggagcggttgcacaatacttggcggccacctctgatcgtgtcaccaaggcagcattcatgtgtaccgctgcaaaattcggcgagccccagggctggctagatcgcgccgcagcgtgccgcgaaaacggcactggttctctgtccgaagctgtgatccagcgctggttctcccccacttggttggagaacaacccagcgtcccgcgagcacttcgaagccatggttgccggcaccccatctgagggttacgcgctgtgctgcgaggcgttggcaacctgggatttcaccgatcgcctgggagaaatcaccgtgccagtgctcaccatcgcaggtgccgatgacccctccactcctccagcaaccgtgcagatcattgccgatggcgttggcggcgagtcccgcgcagaggtcctaagcccagccgcgcacgtaccaaccgtggaacgtccaaacgaggtaaatgaactgctagcacagcatttcgcttaatgttgtaggcatgttcacaaccagtct

SEQ ID NO: 50 - protein, 251 aa, Corynebacterium glutamicum
MAILHSVSYGTSDNTLVFIGSLGSTTDMWLPQLDALHKDFRVIAVDHRGHGLSELIEGTPTVADLAQDVLDTLDDLGVGNFGVIGLSLGGAVAQYLAATSDRVTKAAFMCTAAKFGEPQGWLDRAAACRENGTGSLSEAVIQRWFSPTWLENNPASREHFEAMVAGTPSEGYALCCEALATWDFTDRLGEITVPVLTIAGADDPSTPPATVQIIADGVGGESRAEVLSPAAHVPTVERPNEVNELLAQHFA

SEQ ID NO: 51 - DNA, 1171 bp, Corynebacterium glutamicum
  CDS (101)..(1141): RXA01127
aacgatttccagttgagtcaagccctgcatgatggggtagtgggggttgttgggcaggtacgagctgtgatcaatcagctacactagtgaagtccatatagtgagaagggaatcccacaacatgaaacttgctgttattggtggagatggtatcggcccagaggttactgcagaagccctcaaggttctaaacgctgtccgcgacgacatcgagaccaccgattatgaccttggcgcacgccgttacctcaaaaatggcgagctgctcaccgacgaggatctggcatccctgcgcgagcatgacgcgatccttcttggcgctatcggtgcaccaggttccgtccctccaggaattctcgagcgtggtttgctgctgaagatgcgattcgcactggatcaccacgtgaacctgcgcccatccaagctgtacgacggcgtggagtccccactgcgtaacccaggcaagattgatttcgttgtggtccgcgaaggtaccgaaggcgcctacactggcaacggtggagcaatccgcgtgggaacccctcacgagattgccaatgaaacctccgtgaacactcgctacggcgctgagcgcgttattcgctacgcattcgagctggcacagagccgccgcaagaagctcaccctcgtgcacaagaccaacgtcctggttcacggtggtggcctgtggcagcgcaccgtagatgaggttgcaaaggaatacccagaggtagccgtcgattacaaccacatcgatgcagcaaccatctatctggtcactgatccttcccgcttcgatgtgattgttaccgataacctcttcggcgacatcctcaccgatgaggcaggcgcagtctctggcggaattggcctcgcagcatccggcaacatcgatgccacgggcaccaacccttccatgttcgagccagtccacggctctgcaccagatatcgcaggccagggaatcgcagacccaacggcagcaatcctatccgctgcgatgctgctgcgtcacttaggtgatgaagacaacgcagtacgtattgaaacagccatcgcagctgatgtggctggccgagataactctcagccgatttctaccactgaggtgggagaccgcatcgtcaaggcgctgcaaagctaaatttcaacgccgacccccttgcctttt

SEQ ID NO: 52 - protein, 347 aa, Corynebacterium glutamicum
VRRESHNMKLAVIGGDGIGPEVTAEALKVLNAVRDDIETTDYDLGARRYLKNGELLTDEDLASLREHDAILLGAIGAPGSVPPGILERGLLLKMRFALDHHVNLRPSKLYDGVESPLRNPGKIDFVVVREGTEGAYTGNGGAIRVGTPHEIANETSVNTRYGAERVIRYAFELAQSRRKKLTLVHKTNVLVHGGGLWQRTVDEVAKEYPEVAVDYNHIDAATIYLVTDPSRFDVIVTDNLFGDILTDEAGAVSGGIGLAASGNIDATGTNPSMFEPVHGSAPDIAGQGIADPTAAILSAAMLLRHLGDEDNAVRIETAIAADVAGRDNSQPISTTEVGDRIVKALQS

SEQ ID NO: 53 - DNA, 1153 bp, Corynebacterium glutamicum
  CDS (101)..(1123): RXA01240
ttgttctcacatctacccgtatctttgttggttttagtacccgatagtgagttttgatccctgcacaggaaagttagcggcgctactatgaacgatcgatatgtctgacaacactctctcccaatttggcagttactaccacgaattccgacgtgcccatcccatggccgacgtcgaattcctcctagcaattgaagaattacttacggacggtggtgtcaccttcgatcgcgtcaccacacgcatcaaagaatggtcaagcctgaaagccaaggctcgcaagcgtcgcaacgatggctcgttgatctaccctgatccgcgcaaagacatccacgacatgatcggtgttcggatcaccacgtaccactccacggaaatacccgtggccctaaaagtgctccaagactccttcatcgtccacaaatccgtagacaaagccgctgaaactcgcatctcaggcggctttggttacggctcccaccacctgattctggaagtcgatgacacctccgatgacctccaggactacaaaggcctcgtctttgaagttcaggtgcgcaccgtgctgcaacacgcctgggcagagttcgaacacgatatccgctataaacgcgccgatgtgtccaacccagaagacttcagcgcagaagtagaccgcatgttcaccctcgctgccggactcatcgaattagcggaccaacaattcgaccaaatcgccgcactcaaagaaaccagccgagttgctgatgaatccgtcgaactcaccgcagagacacttcccggcgttcttgccatgctcattggcaaccgcttcccccgcccacgctccacaaactaccgcttcctcgaagacatcctggtggccaactccattacctctgtggtgcagctgcgcgagctgctcaaccccaccgacattgaagtgctgttgaaagtaatgaactaccgcttccacccaggccagatccgcatcatcgacgatttactactcaaacgatttggccaatcacacatcgatgccaccgtcgccaccgactcccaaccactcaacgccaaacgccacaggcagctaaaacgcaagctagagctcatgacccaagctcatcttgtggaaccaccaaactaaagttcccccaaagttagccccggctaa

SEQ ID NO: 54 - protein, 341 aa, Corynebacterium glutamicum
MSDNTLSQFGSYYHEFRRAHPMADVEFLLAIEELLTDGGVTFDRVTTRIKEWSSLKAKARKRRNDGSLIYPDPRKDIHDMIGVRITTYHSTEIPVALKVLQDSFIVHKSVDKAAETRISGGFGYGSHHLILEVDDTSDDLQDYKGLVFEVQVRTVLQHAWAEFEHDIRYKRADVSNPEDFSAEVDRMFTLAAGLIELADQQFDQIAALKETSRVADESVELTAETLPGVLAMLIGNRFPRPRSTNYRFLEDILVANSITSVVQLRELLNPTDIEVLLKVMNYRFHPGQIRIIDDLLLKRFGQSHIDATVATDSQPLNAKRHRQLKRKLELMTQAHLVEPPN

SEQ ID NO: 55 - DNA, 1105 bp, Corynebacterium glutamicum
  CDS (101)..(1075): RXA01253
caggctggcaagaagccctctccatggttgatcgcacagctgatggcttagtcatcgtcgtcaatggccaggttgccgacggcgaagacctctcctggctttgggacgtccgcttcgaagacttcgaaaacctctccgtcaaagcctccggcgagcgcggcaccgacctggcagtccgcctcacctacgccgaaatcgaccacgaactcatctccaaccccgtcgacgccatcgcagcctgccctcctggccgcatcgaagtcctcgccaactacaccgcattccgagacctcaaaaaggctctggagaaagggaccgaacaataatgaccaccctcaacatcggcctcatcctccccgacgtcctcggaacttacggcgacgacggcaacgcactagtcctgcgccaacgcgcacgcatgcgtggcattaatgctgaaatccagcgcgtcaccctcgacgacgccgtcccttccacccttgatctctactgcctcggcggcggcgaggacaccgcacagatccttgccaccgaacacctcaccaaagacggcggcctccaaaccgcagccgccgcaggccgccccatcttcgcagtctgcgcaggtctccaggtactcggcgactccttccgcgccgccggccgtgtcatcgacggccttgggcttatcgacgccaccaccgtctctttacaaaaacgcgccatcggagaagtcgaaacgacaccaacccgcgccggattcaccgccgagctgaccgaacgactcaccggcttcgaaaaccacatgggcgccaccctgctcggccccgacgccgaaccactcggccgagtcgtccgcggcgaaggcaacaccgatgtctgggcagcctccgaaaacaccgacgaccaacgccaacaattcgccgaaggcgccgtccaaggcagcatcatcgccacctacatgcacggccccgcactcgcccgaaacccccaactcgccgacctcatgctcgcaaaagcaatgggtgtcgcgctgaaagacctggagcctttggacatcgacgtcatcgaccgcctccgcgccgaacgcctggcgtagccccttctaaaccgggtctactcgaaa

SEQ ID NO: 56 - protein, 325 aa, Corynebacterium glutamicum
LGRPLRRLRKPLRQSLRRARHRPGSPPHLRRNRPRTHLQPRRRHRSLPSWPHRSPRQLHRIPRPQKGSGERDRTIMTTLNIGLILPDVLGTYGDDGNALVLRQRARMRGINAEIQRVTLDDAVPSTLDLYCLGGGEDTAQILATEHLTKDGGLQTAAAAGRPIFAVCAGLQVLGDSFRAAGRVIDGLGLIDATTVSLQKRAIGEVETTPTRAGFTAELTERLTGFENHMGATLLGPDAEPLGRVVRGEGNTDVWAASENTDDQRQQFAEGAVQGSIIATYMHGPALARNPQLADLMLAKAMGVALKDLEPLDIDVIDRLRAERLA

SEQ ID NO: 57 - DNA, 1132 bp, Corynebacterium glutamicum
  CDS (101)..(1102): RXA01321
ggacacagatcgtgccgactcccagctcaattgcggaatctataaatgcggccagttcggagttggttacttctggtccgaggagggtgtagtcaaggatttgggccatggtggagcgggaaatcgtcatatccataccctacttagacctgacttagtgtgggaaaatttccagggtagaatgcaacgaatgaccccgagttctcctgaagttcgtaatcgtccgagcgctgcgcctgaagagcgtcagtttgtgctcacttttggctgccctgactccactggaattgtggcgaagttgtcgtcgttcctagctgagcgtgggggttggattactgaggctggatatttcacggatcctgattcgaattggttctttactcgtcaggcgattcgcgctgagtcgattgataccacgattgagcagttgcgggaggagttcgctccgcttgcggaggagttcggcccgagggctaagtggagtttcactgacactgcgcaggtgaagaaggctgtgttgttggtgtctaaggagggccactgcttgcacgatttgttaggtcgtgtggctgagaatgattatccgatggaagttgttgcggttgtgggtaaccatgagaacttgcgttatattgcggagaaccataatgttccgtttttccatgtgccgtttcctaaggatgcggttggtaagcggaaggcgtttgaccaggtcgctgagattgtgaatggttatgatccggatgcgattgttttggctcgttttatgcagattttgccgccggatttgtgtgagatgtgggctggtcgtgtgttgaatattcatcacagtttcttgccgtcgtttatgggtgcgcgcccgtatcatcaggcgtatagccgtggtgtgaagttgattggtgcgacctgccattatgcgactggggatctggatgatggtccgatcattgagcaggatgttattcgtgtgacgcataaggatacgccgactgagatgcagcgtttgggccgcgatgcggagaagcaggtgctggctcgcggtttgcgtttccacttggaggaccgggtgctggtttacggtaaccgcacggttgtctttgattaaggctttttgcttttcgacgcgacccta

SEQ ID NO: 58 - protein, 334 aa, Corynebacterium glutamicum
LGHGGAGNRHIHTLLRPDLVWENFQGRMQRMTPSSPEVRNRPSAAPEERQFVLTFGCPDSTGIVAKLSSFLAERGGWITEAGYFTDPDSNWFFTRQAIRAESIDTTIEQLREEFAPLAEEFGPRAKWSFTDTAQVKKAVLLVSKEGHCLHDLLGRVAENDYPMEVVAVVGNHENLRYIAENHNVPFFHVPFPKDAVGKRKAFDQVAEIVNGYDPDAIVLARFMQILPPDLCEMWAGRVLNIHHSFLPSFMGARPYHQAYSRGVKLIGATCHYATGDLDDGPIIEQDVIRVTHKDTPTEMQRLGRDAEKQVLARGLRFHLEDRVLVYGNRTVVFD

SEQ ID NO: 59 - DNA, 1243 bp, Corynebacterium glutamicum
  CDS (101)..(1213): RXA01381
gcgatggccgaatccatgttccacgccgttgaagccggaagattagccgcccaagcaggccggatcccgcaacgccaacatgcggtggcctcatcaagttttgaaggtttggcatcctgggcggagcaggtgctttaacatggcgcagcttcccacatctgagcttcaccgcacggcccgccaactcgcgctccccggatatggtattgagcagcaggaacgacttttcaacgcccacgttctagtcatcggcgcaggcggtctcggctgcccagtcatgcagtcgctggcttccgcaggcgttggaaccatcacggtcatcgatgacgacaccgtcgacatttccaacattcaccgccaaatcctcttcggcgcaagcgatgtcggtcgacccaaggtcgaggttgccgccgagcgcctcaaagaactccaaccagacatcaccgtcaacgcgttgcacgaacggatcactccagaaaacgcctgcgagctgctcaattccgtggacctcgtcttagacggctccgattctttctccacaaaatacttagtgtctgatgccgccgaaatcaccggaactcccctcatctgggcaacggtactgcgctttcacggcgaactggcactcttcaactctggccccgaccaccgcggagtcggcctgcgcgacgtcttccccgaacaaccctccgccgatttcgtccctgactgcgccaccgctggtgttcttggcgccaccacagccaccatcggcgcactcatggccactcacgccatcggatttctcacagaaatcggcgacgtccaaccaggcacaatcctctcctacgacgcattccccgccgccacgcgcagcttccgcgtctccgccgacccggcgcgcccactggtcacccgcctccgcgcctcctacgaggcagcgcgcaccgatacaacttcgcttatcgacgccaccctcaacggctccctcaccgccctcgatatccgagagccacatgaagttctgctcaaagacctccccgagggcgcaacgtcactgaagctccccttaagccagatcacctcggacagcgacattttagaggcactgtctggaatcgacggcgacattttggtctactgcgcttcgggaatccgcagttccgacttcatcgacaactactcccacctcggccacaaatttgtgaatcttcccggtggggtcaacgcgctgtagctgtcaatttaagaggccagaattctg

SEQ ID NO: 60 - protein, 371 aa, Corynebacterium glutamicum
LKVWHPGRSRCFNMAQLPTSELHRTARQLALPGYGIEQQERLFNAHVLVIGAGGLGCPVMQSLASAGVGTITVIDDDTVDISNIHRQILFGASDVGRPKVEVAAERLKELQPDITVNALHERITPENACELLNSVDLVLDGSDSFSTKYLVSDAAEITGTPLIWATVLRFHGELALFNSGPDHRGVGLRDVFPEQPSADFVPDCATAGVLGATTATIGALMATHAIGFLTEIGDVQPGTILSYDAFPAATRSFRVSADPARPLVTRLRASYEAARTDTTSLIDATLNGSLTALDIREPHEVLLKDLPEGATSLKLPLSQITSDSDILEALSGIDGDILVYCASGIRSSDFIDNYSHLGHKFVNLPGGVNAL

SEQ ID NO: 61 - DNA, 3457 bp, Corynebacterium glutamicum
  CDS (101)..(3427): RXA01434
acgggatcgcccaaaccgccaccaacccactaacgtatcgcatagttattttcgccgtgctcgccgttaaggcgcgcactcgtacatgaatggtcaacaagtgagttcttcgctttcgaataattcggagcagtccggcctgcgtggcaggatcgttgctccagcaccgccggcgcctgtgcccgaggcgcgcaagaaggctgtcgcacgcacggatggtgatcgctcgagtttgaaaaactcgcctacggcatccgccacccaggcagcccagacgcgcccggcagaaccggaaccaaaaaagcacacctccgattctgatgtggtgcgctcgactggctccatggcaatagccacgctgctgagtcgtatcaccggtttcctgcgcaccgtgatgattggtgcggcgctgtcgccggccatcgcttcggcgttcaacactgccaacacgctgcccaacctgatcactgaaatcgtgttgggtgcggtgctgacatcgctggttattccggtccttacccgcgcggaaaaagaagacgccgacggcggttccgggttcttcaggcggctgctcaccctgtcggtgacgctgctgggtggtgtcaccatcctgtcgattatcggcgcgccgctgctgacacggatgatgctgtcctctgagggacaagtcaacgtggtcatgtccacggcctttgcgtattggctgctgccacagattttcttctacggcctgtttgccctgttcatggctgtgttgaacacccgtgaagtgttcaaacccggcgcgtgggcacctgttgtcaacaatgtgatcaccttgaccgtgctgggcgtgtacatggtgctgcctgcgcgtttgcacccgcatgagcaggtgggcatttttgatccgcagatcattttcctcggcgtgggcaccacccttggtgtggttgcacagtgtctaatcatgattccgtacctgcgtcgcgcgggcattgatatgcgccctctgtggggtatcgatgcgcgtttgaagcaattcggtggcatggcgatggcgatcatcgtgtacgtggcaatctcccagttcggttacatcatcaccactcgcattgcgtcgattgcagacgatgctgcgccgtttatttatcagcagcactggatgttgctgcaagttccttatggcatcatcggcgtcaccttgctcaccgcgattatgccgcgactgtcccgcaacgcggcagacggcgatgatagggcagtagtctctgaccttcagttgggttccaagctaaccttcatcgcactgatccccatcgtggtgttcttcaccgccttcggtgtccctattgccaatggcctttttgcctacggccaattcgatgccaacgccgccaacatccttggttggactctgagcttctctgctttcacgctgattccttacgctttggtgctgctacatctgcgtgtgttttatgcgcgtgaagaggtctggaccccaaccttcatcatcgccggcatcaccgccaccaaggtcgtgctttccctgttggcaccgctgctgtcgagctccccggagcgtgtggtggtgcttcttggtgcggccaacggtttcagtttcatcaccggcgcggtcatcggcgcgtatctgttgcgcaacaaactcggcctgttgggtatgcgctctttggctaaaacctccctgtgggcgttgggctctgcggcggttggtgcagcagcagcatgggcgttggggtggctgattcaagccgtcgtgggcgatttcttgctgggcactctaagctccgtaggctacttgttgaacctggctgtgttgggtgtcttcttcatcttcgtcaccggcatcgtgttgtcacgttctggtttgccggaggtccaaaacttgggccaggcactgacccgcatcccaggtttgagccggtttattcgcccgaataccaagatctctttggatgtcggcgaagtctccgagcaggatttctccacccagctggtcgcgccaagcgagttcgcagcaacccctgtgccgccaccgatgtccgccggtattgtccgcggacctcgcctggttcccggcgccccagtcggcgacggtcgtttccgtctgctcgccgatcacggcggcgtccaaggcgcgcgtttctggcaggcccgcgagatcgccaccggcaaggaagtcgcgctgatctttgtggatacttccggcaacgccccatttgcgccactgtcttcggcagccgcagcgggcatcgcctacgaggtgcagcgccgcaccaagaagctggccagcttgggcagcttggcggtagcccccaacatccactccgaggcgtaccgcaacggttgcctcattgtggccgattgggtgcctggctccagcttgagcgccgtcgcggaatccggtgccgatccccgcgccgccgcgttcgcgctcgcggaactaactgaaaccatcggcgaggcccacgagatgggtatcccggccggcttggacaacaagtgccgcatccgcatcaacaccgacggccatgccgtcctcgccttcccggcgattttgcccgatgcctcagagctccgcgacgccaagtccctggcctcggccgccgagatgcttatcgacgcgaccctcgctcccagcgacgtcaaggcaatggtcactgaagcccaggggctagctacagaagacaatcccgattacgcatcacttgccatggcgatgcgcacctgcggactgttcaccgaggaaccaacccaccttgtggtgaagaaggaaaagacaccaaagcctgcgacacgtgatggtttcggtgcctccgactacaccgtcaagggcatggcagccatcgccgctgtggtgatcatcttggtttccctggtggccgccggtaccgcgttcctcaccagcttcttcggcagcagcaccaacgaacaatccccgttggcctctgttgaagccaccacctctgcaacaccagaacctgtggggccaccggtctacctggatctggatcaagcccgcacgtgggatgacggtgcaggaacagatgtcaccgacgtcaccgacggcaacacctccaccgcatggacctccaccggcggcgacggcctcctagttgacctgtccacgcctgcccgcctcgaccgcgtcatcttgaccaccggcaccggctccgacagcaacgtgacctcgaccgtgaagatctacgcattcaacgacgcctcaccacactccctgtcggaaggcatcgagatcggcaccgtggattattccggccgcagtctcagccacagcatccgcgattcctccaagcttccgggtcaggtggaatccgtggtgattctggtcgatgaggttcgttcctcacaaacctcagacaccaatccacagatgcagatcgctgaagtacaacttgttggttggtaaattacgcgtttgtgattgacccccatt

SEQ ID NO: 62 - protein, 1109 aa, Corynebacterium glutamicum
VSSSLSNNSEQSGLRGRIVAPAPPAPVPEARKKAVARTDGDRSSLKNSPTASATQAAQTRPAEPEPKKHTSDSDVVRSTGSMAIATLLSRITGFLRTVMIGAALSPAIASAFNTANTLPNLITEIVLGAVLTSLVIPVLTRAEKEDADGGSGFFRRLLTLSVTLLGGVTILSIIGAPLLTRMMLSSEGQVNVVMSTAFAYWLLPQIFFYGLFALFMAVLNTREVFKPGAWAPVVNNVITLTVLGVYMVLPARLHPHEQVGIFDPQIIFLGVGTTLGVVAQCLIMIPYLRRAGIDMRPLWGIDARLKQFGGMAMAIIVYVAISQFGYIITTRIASIADDAAPFIYQQHWMLLQVPYGIIGVTLLTAIMPRLSRNAADGDDRAVVSDLQLGSKLTFIALIPIVVFFTAFGVPIANGLFAYGQFDANAANILGWTLSFSAFTLIPYALVLLHLRVFYAREEVWTPTFIIAGITATKVVLSLLAPLLSSSPERVVVLLGAANGFSFITGAVIGAYLLRNKLGLLGMRSLAKTSLWALGSAAVGAAAAWALGWLIQAVVGDFLLGTLSSVGYLLNLAVLGVFFIFVTGIVLSRSGLPEVQNLGQALTRIPGLSRFIRPNTKISLDVGEVSEQDFSTQLVAPSEFAATPVPPPMSAGIVRGPRLVPGAPVGDGRFRLLADHGGVQGARFWQAREIATGKEVALIFVDTSGNAPFAPLSSAAAAGIAYEVQRRTKKLASLGSLAVAPNIHSEAYRNGCLIVADWVPGSSLSAVAESGADPRAAAFALAELTETIGEAHEMGIPAGLDNKCRIRINTDGHAVLAFPAILPDASELRDAKSLASAAEMLIDATLAPSDVKAMVTEAQGLATEDNPDYASLAMAMRTCGLFTEEPTHLVVKKEKTPKPATRDGFGASDYTVKGMAAIAAVVIILVSLVAAGTAFLTSFFGSSTNEQSPLASVEATTSATPEPVGPPVYLDLDQARTWDDGAGTDVTDVTDGNTSTAWTSTGGDGLLVDLSTPARLDRVILTTGTGSDSNVTSTVKIYAFNDASPHSLSEGIEIGTVDYSGRSLSHSIRDSSKLPGQVESVVILVDEVRSSQTSDTNPQMQIAEVQLVGW

SEQ ID NO: 63 - DNA, 1354 bp, Corynebacterium glutamicum
  CDS (101)..(1324): RXA01442
aattaagcaacctttttaacaggtttagagctttcacgaggtggcgtcagataaagtgaacaccaatatttctgacatcttccaacggaggctaaaaggcatgtacatcccagagtcgatcggcacccctttgacccccaatgccacgaaagtgatgctgctgggatcaggagaattaggcaaagaagtagccatcgctttccagcgtctcggcctggaagtccatgcagttgatcgctacgaacatgccccagcccaccaggtcgctcacttctcctatgtcatcgacatgacagatgcagcccaggtgcgggaattggtggagcgtgtgcgcccagattttgtcattcctgaaatcgaagcactggcaaccgatgaactggtgaagatcgaagaagaggggctagctaccatcgtgcccactgcacgtgcagccaagctgaccatgaaccgcgaaggcatccgcaagctggcggcagaggaactgggtcttccaacctccaactatgagttctgctccactttcgaggaattctccgcagctgctgaaaagcttggttaccccaacgtggtgaaaccagtgatgagttcttccggcaagggccaatctgttttgcgtagttcagacgatctgcaggcagcatgggattatgcgatgagcggtgcacgcgtggccaactcccgcgtcatcgtggaagctttcgtggaattcgattacgagatcaccctgttgacagtaaggtccatcgatcccaccacctctaagcctgcgacctggttctgtgagcccattgggcaccgccaagaagacggcgactacgtggaatcctggcagccaatggagatgactcctcgcgcgctggaaaacgcacgctcagtagccgcacgcatcaccaacgcattgggcggacgcggcgtatttggtgtggagctctttgtctccggcgatgacgtgtacttctctgaagtctccccacgcccacacgacaccggccttgtcacccttgccacccagcgtttctctgaatttgaactccacgccaaggcaattctgggattgcctgttgatgtcaccctgatttctccaggtgcctccgctgtcatctacggtggcatcgaatctgaaggcgtgagctacaccgggttggctgaagcgctggcagtggctgaaactgatcttcgtatctttgccaagccagaggccttcaccaagcgtcgcatgggtgttgcagtgtccaccgctgaggatgtggctgcagccagggaccgcgccactttggctgccgcggcgatcaaggttcatccaggaaattccgcagaggcttaacatgctgggaaagcatcggggcagcat

SEQ ID NO: 64 - protein, 408 aa, Corynebacterium glutamicum
MYIPESIGTPLTPNATKVMLLGSGELGKEVAIAFQRLGLEVHAVDRYEHAPAHQVAHFSYVIDMTDAAQVRELVERVRPDFVIPEIEALATDELVKIEEEGLATIVPTARAAKLTMNREGIRKLAAEELGLPTSNYEFCSTFEEFSAAAEKLGYPNVVKPVMSSSGKGQSVLRSSDDLQAAWDYAMSGARVANSRVIVEAFVEFDYEITLLTVRSIDPTTSKPATWFCEPIGHRQEDGDYVESWQPMEMTPRALENARSVAARITNALGGRGVFGVELFVSGDDVYFSEVSPRPHDTGLVTLATQRFSEFELHAKAILGLPVDVTLISPGASAVIYGGIESEGVSYTGLAEALAVAETDLRIFAKPEAFTKRRMGVAVSTAEDVAAARDRATLAAAAIKVHPGNSAEA

SEQ ID NO: 65 - DNA, 1402 bp, Corynebacterium glutamicum
  CDS (101)..(1372): RXA01483
ggtggccgataaggtggaagcatctttgcgcgcaatccaaggtctgctgcgcccttcgcggcgtgcacgccatgagcaacttcggaggctgaaaaagtagatgtacccctattccgacgcagacgcttttcgacgccagcctgagcgcgccaagtccagccaactgcgtaccagcgccgtagacacccgcagcgcgttcgcccgcgaccgggctcgcgtgctgcattctgctgctcttcgacgcctcgcggataaaacccaagtggttggccccaatgatggtgatactccgcgcacccggctgacgcactctttggaagtagctcaaattgcacggggaatcggagctggactggatttggatcctgatctgtgcgatctggcagggctgtgccatgacattgggcatccgccgtatggacacaacggtgaaaacgcgttgaatgaagttgctgcggcctgtggaggatttgagggcaacgcccaaaccttgcgtattctcacgcgtctggagccaaaaattgtctctgatgagggggagagctttgggctgaacttgtcgcgggctgctcttgatgctgcatgtaagtatccgtgggctaaaacaaatgcggatggcagtgtcaataagaaatacagtgcttatgacgaggacgcagaaatcctcgcttggattagacaaggccatgaggatcttcgcccaccgatcgaagcgcaggtcatggacttttctgatgacattgcctactcggtgcacgatgtggaagacggtattgtatccgggcgtatcgacttaaaagtgctgtgggacctggttgaattagcagctttggcagacaaaggagcagctgctttcggaggttcgcctgcagagctcatcgagggtgcagcatcgttgcgggaacttccggtggtggctgccgctgcggattttgatttctcactgcgttcctacgctgcgctgaaggcgatgacttcagaactagtgggaagatacgttggctctaccatcgagtcaacaaagaaaacacacgctggcattgatgtgggacgcatgcacggcgatttgatcattccagaaacagcggccagtgaagtaaaactgctcaaaacgttagcggttctctacgtgatggatgacccagggcaccttgcgcgccaaaacaggcaacgggatcgtatcttccgggtttttgactacctggtgctgggggctccgggatcgttggatccgatgtatcgccagtggtttattgaagcggattcagaatcggaacagatccgtgtgattgttgatcagattgcgtcgatgacggagtctcgtctggaacgccttgcccggaatgctgctgacatctcaggatttttgggataattggttagagcagcagtaagtttcagt

SEQ ID NO: 66 - protein, 424 aa, Corynebacterium glutamicum
MYPYSDADAFRRQPERAKSSQLRTSAVDTRSAFARDRARVLHSAALRRLADKTQVVGPNDGDTPRTRLTHSLEVAQIARGIGAGLDLDPDLCDLAGLCHDIGHPPYGHNGENALNEVAAACGGFEGNAQTLRILTRLEPKIVSDEGESFGLNLSRAALDAACKYPWAKTNADGSVNKKYSAYDEDAEILAWIRQGHEDLRPPIEAQVMDFSDDIAYSVHDVEDGIVSGRIDLKVLWDLVELAALADKGAAAFGGSPAELIEGAASLRELPVVAAAADFDFSLRSYAALKAMTSELVGRYVGSTIESTKKTHAGIDVGRMHGDLIIPETAASEVKLLKTLAVLYVMDDPGHLARQNRQRDRIFRVFDYLVLGAPGSLDPMYRQWFIEADSESEQIRVIVDQIASMTESRLERLARNAADISGFLG

SEQ ID NO: 67 - DNA, 982 bp, Corynebacterium glutamicum
  CDS (101)..(952): RXA01515
taagcctggtgctgtgaccacgacgtctgcggtgcgcggcggttttaagaacaacgctgcctcccgcgctgaggtgttctccctgattcgggggcactaaatgaacgtatcctctttgaccatcccgggacgctgtttggtcatgggaattgtcaatgtcactgaggattccttttcggacggtggcaagtacattgacgttgatcaggcgatcgcgcatgccaaggaattggtggctgctggcgccgacatgattgatgtcggcggcgagtccacccggcctggggcagtgcgcgtcgacgcgtccgtggaacgggaccgggttgtgccggtcattaaggcgcttcacgacgccggcatccacacttccgtagacaccatgcgggcctccgtggcgcaggctgccgcgggcgctggcgtctccatgatcaacgacgtctctggcggtttggctgatcctgagatgttttctgtcatggcggaagcgcaaattcccgtgtgtttgatgcactggcgcaccctccaattcggtgatgccgcaggtcaggcagatcacggtggagacgttgtagccgatgtgcacgcagtgcttgatgatcttgtcgcccgcgccaccgctgctggtgtggccgaaaaccagatcgtgcttgatccaggtttgggttttgccaaatcacgtgaagacaactggcgtttgctgcaagcactgcccgagtttatttctggacctttccccatcctggtgggagcatcccggaagcgattcctggctggcgtgcgcaaagaccgtggcctagatgtcacccccattgatgccgacccagcaaccgcagcggtgaccgcagtgtctgcacatatgggagcatggggtgtgcgcgtgcacgatgtcccagtatcaagggacgctgttgatgttgccgcattgtggcgaagtggaggaactcaccatggctgatcgtattgaacttaaaggccttgaatg

SEQ ID NO: 68 - protein, 284 aa, Corynebacterium glutamicum
MNVSSLTIPGRCLVMGIVNVTEDSFSDGGKYIDVDQAIAHAKELVAAGADMIDVGGESTRPGAVRVDASVERDRVVPVIKALHDAGIHTSVDTMRASVAQAAAGAGVSMINDVSGGLADPEMFSVMAEAQIPVCLMHWRTLQFGDAAGQADHGGDVVADVHAVLDDLVARATAAGVAENQIVLDPGLGFAKSREDNWRLLQALPEFISGPFPILVGASRKRFLAGVRKDRGLDVTPIDADPATAAVTAVSAHMGAWGVRVHDVPVSRDAVDVAALWRSGGTHHG

SEQ ID NO: 69 - DNA, 604 bp, Corynebacterium glutamicum
  CDS (101)..(574): RXA01518
agcagaacctgatgccgtcctgcacggcacgaccattgcagaacatgtggataatcttgatcccacagacattgaaggtgtcaccaagatttaaggagtcgtggctttcatgcagaaaacgtcagcgggttggttgatcgcaacgggaggtttcctcgccgctgtgtccgccattttgacgtggcgtttttatggatccatgacctctatttccatcacggtatccatcactttttggttgttggccgtggtgtgtggtttcgcaggtgtgaaggtccaaggtcgcctcgatgaggggctgatcggccaggacaaatcccaaatgaaccccgtgaccattgcctatctggccatgctgggtcgagcgtgtgcgtggggtggcgcaattttcggcggcgtttatgtgggaattggcagttatgtaatcccacgcgccggtgagttgtccgcagcatcgaatgatcttccgggagttattgcctgtgcgctgggcggaatcgcactctcagctgccggactttatttagagcgaagctgtgaggctccgcctccccaatctggcgaagcgatcagctagattggaattcatgaatcaagacctgtc

SEQ ID NO: 70 - protein, 158 aa, Corynebacterium glutamicum
VAFMQKTSAGWLIATGGFLAAVSAILTWRFYGSMTSISITVSITFWLLAVVCGFAGVKVQGRLDEGLIGQDKSQMNPVTIAYLAMLGRACAWGGAIFGGVYVGIGSYVIPRAGELSAASNDLPGVIACALGGIALSAAGLYLERSCEAPPPQSGEAIS

SEQ ID NO: 71 - DNA, 1267 bp, Corynebacterium glutamicum
  CDS (101)..(1237): RXA01690
gggggaggcatcaaattgaaactaacttttaacaagcctagccattcctcaaaaccgtgagacgaaattggctattcatcccataaaatggggctgactagtgtatctgtcaggtagcaggtgtaccttaaaatccatgacgtcattagagttcacagtaacccgtaccgaaaatccgacgtcacccgatcgtctgaaggaaattcttgccgcaccgaagttcggtaagttcttcaccgaccacatggtgaccattgactggaacgagtcggaaggctggcacaacgcccaattagtgccatacgcgccgattcctatggatcctgccaccaccgtattccactacggacaggcaatttttgagggaattaaggcctaccgccattcggacgaaaccatcaagactttccgtcctgatgaaaacgccgagcgtatgcagcgttcagcagctcgaatggcaatgccacagttgccaaccgaggactttattaaagcacttgaactgctggtagacgcggatcaggattgggttcctgagtacggcggagaagcttccctctacctgcgcccattcatgatctccaccgaaattggcttgggtgtcagcccagctgatgcctacaagttcctggtcatcgcatccccagtcggcgcttacttcaccggtggaatcaagcctgtttccgtctggctgagcgaagattacgtccgcgctgcacccggcggaactggtgacgccaaatttgctggcaactacgcggcttctttgcttgcccagtcccaggctgcggaaaagggctgtgaccaggtcgtatggttggatgccatcgagcacaagtacatcgaagaaatgggtggcatgaaccttgggttcatctaccgcaacggcgaccaagtcaagctagtcacccctgaactttccggctcactacttccaggcatcacccgcaagtcacttctacaagtagcacgcgacttgggatacgaagtagaagagcgaaagatcaccaccaccgagtgggaagaagacgcaaagtctggcgccatgaccgaggcatttgcttgcggtactgcagctgttatcacccctgttggcaccgtgaaatcagctcacggcaccttcgaagtgaacaacaatgaagtcggagaaatcacgatgaagcttcgtgaaaccctcaccggaattcagcaaggaaacgttgaagaccaaaacggatggctttacccactggttggctaaatcaaccggttttaagaccccgctgca

SEQ ID NO: 72 - protein, 379 aa, Corynebacterium glutamicum
VYLSGSRCTLKSMTSLEFTVTRTENPTSPDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 73 - DNA, 910 bp, Corynebacterium glutamicum
  CDS (101)..(880): RXA01746
ctgcagctctaagatctctgcaagttaaaaccgccactcccctttcactggggagtggcggttttgtcgtttcatgcatgcagtgtgtgacttatcaaccttgttagggctagggtggatatctatcatgactgcaccaagagatccttttttccccgcagatctttctatccgcgcgtctgcagagcccattgaaattcagcggttgggtttgatcgattatcaagaggcctgggattatcaagcagagcttgctacccgtagggctaatgatgaaatccctgatcagctgcttattttggagcacccgtcggtgtataccgcaggtaagcgcacccagccggaagatcttcccaccaacggactgccggtgatcaatgctgatcgtggtggtcgcatcacgtggcatggtcctggccaattggtgatctatccgatcatcaaattagccgatccgatcgatgtggttgattacgtaagacgcctcgaggaagcgctcatccaagttgtcggcgatatgggtgttgccggcgctgggcgcattgatgggcgttcgggtgtgtgggtgccagctcatgatggttgggtggacagcaaggttgcggccatcggcattcgaataactcgtggtgttgcaatgcacggtgtggccatcaactgcaacaacacgttggatttctatgagcacatcattccgtgtggcattgctgatgcaggcttgagcacactctcgagggaactgaaaagggacgtttcagttgaggaattagtcgagccatcgatccgcgcattggatgatgctttggctggtcggctggttgtttctgatcattctttcggcagcgcgcccgacccaactaagaatctccctaaacgggggtagtacgaggaattttgtcggtggggcgcc

SEQ ID NO: 74 - protein, 260 aa, Corynebacterium glutamicum
LLGLGWISIMTAPRDPFFPADLSIRASAEPIEIQRLGLIDYQEAWDYQAELATRRANDEIPDQLLILEHPSVYTAGKRTQPEDLPTNGLPVINADRGGRITWHGPGQLVIYPIIKLADPIDVVDYVRRLEEALIQVVGDMGVAGAGRIDGRSGVWVPAHDGWVDSKVAAIGIRITRGVAMHGVAINCNNTLDFYEHIIPCGIADAGLSTLSRELKRDVSVEELVEPSIRALDDALAGRLVVSDHSFGSAPDPTKNLPKRG

SEQ ID NO: 75 - DNA, 1207 bp, Corynebacterium glutamicum
  CDS (101)..(1177): RXA01810
ccaccaccacaatgttgctcatcctcgcggcgttcgttgtcgcaggtggctccatgactcgcttcaccgtcggcaacccgactggaaaataaggcttcacatgaataacgcttttcgacgcacccttacatccgtagtcctcgccgctagcttggccttaacggcctgcgcaagctgggattcacctacggcatcttccaatggtgatctgattgaggagatccaggcaagctccacctcaacagatccgcgcaccttcacaggcttgagcatcgtggaagatatcggcgatgtggttcccgtaaccgacaacgcctcaccagctctgccagtttctttgaccgacgctgatggcaacgacgtggtggtggaggacgtgtcccgcatcctcccactggatctctacggaacctattccaaaaccatcgctggcctgggactcgtggacaatattgtgggtcgtactgttagttccaccgagcctgcattggcggacactgaggtggtcaccactggcggacacaccctcaatgctgaagcgatccttaatttacatccgactttggtgatcatcgaccactcgatcggcccacgcgaagtcatcgatcagatccgcgcagctggtgtcgccacggtgatcatgtcgccgcagcgttccattgcctcaattggcgacgacatccgcgacatcgcctccgtcgttggacttcctgaagaaggggagaagctcgcggaacgttccgttgctgaagtcgaagaggccagcacggttgtcgatgaactcaccccagaagatcccctcaaaatggtattcctctatgcccgcggaactggtggagtgttcttcattttgggcgatgcctatggtggacgcgatctcattgaaggcctgggcggcgtcgacatggctgctgaaaagggcatcatggatctggcaccagccaacgcggaagcacttgccgaactaaatccagacgtcttcgtgatgatgtcggaaggactagtctcgacaggaggtatcgacggtcttatggaacgccccggcattgctcagacaaccgccggacaaaaccaacgagtactggcgcttcccgatggtcaatcattggcctttggtgcccaaactggcgagttgttgctccgcgcatcccgcgaactgtatgtgcagggcggcgagtagatggttgtgaaggaggttgacgtcgaa

SEQ ID NO: 76 - protein, 359 aa, Corynebacterium glutamicum
MNNAFRRTLTSVVLAASLALTACASWDSPTASSNGDLIEEIQASSTSTDPRTFTGLSIVEDIGDVVPVTDNASPALPVSLTDADGNDVVVEDVSRILPLDLYGTYSKTIAGLGLVDNIVGRTVSSTEPALADTEVVTTGGHTLNAEAILNLHPTLVIIDHSIGPREVIDQIRAAGVATVIMSPQRSIASIGDDIRDIASVVGLPEEGEKLAERSVAEVEEASTVVDELTPEDPLKMVFLYARGTGGVFFILGDAYGGRDLIEGLGGVDMAAEKGIMDLAPANAEALAELNPDVFVMMSEGLVSTGGIDGLMERPGIAQTTAGQNQRVLALPDGQSLAFGAQTGELLLRASRELYVQGGE

SEQ ID NO: 77 - DNA, 1582 bp, Corynebacterium glutamicum
  CDS (101)..(1552): RXA01850
caaaccggccatcgccctttggaatcggtccgaaaattgcaggtacagagccttttaccgagaaaatccaccacagattgctgaaatttcgtgatctgtggtggattcgtgcaacttcagactcttacggaggcgatggaccaaaaacaactacaatcaagcagatcaccttgtacaccaccatagaaaaggcccaccctcagccatggctatcagtgttgttgatctatttagcatcggtatcggaccatcatcctcacataccgtcggccccatgagagccgccctcacgtatatctctgaatttcccagctcgcatgtcgatatcacgttgcacggatcccttgccgccaccggtaaaggccactgcactgaccgggcggtattactgggtctggtgggatgggaaccaacgatagttcccattgatgctgcaccctcacccggcgcgccgattcctgcgaaaggttctgtgaacgggccaaagggaacggtgtcgtattccctgacgtttgatcctcatcctcttccagaacaccccaatgccgttacctttaaaggatcaaccacaaggacttatttgtcggtgggtggtgggttcattatgacgttggaggatttccggaagctggacgatatcggatcaggtgtgtcaaccattcatccagaggcagaggtgccttgtccttttcagaagagttcccaattactcgcatatggtcgcgattttgcggaggtcatgaaggataatgagcgcttaatccacggggatcttggcacagtggatgcccatttggatcgagtgtggcagattatgcaggagtgcgtggcacaaggcatcgcaacgccggggattttaccgggtgggttgaatgtgcaacgtcgggcgccgcaggtacacgcgctgattagcaacggggatacgtgtgagctgggtgctgatcttgatgctgtggagtgggtgaatctgtacgccttggcggtgaatgaagaaaacgccgctggtggtcgtgtggttactgctccgactaatggtgctgcggggattattccggcggtgatgcactatgcgcgggattttttgacaggttttggggcggagcaggcgcggacgtttttgtataccgcgggtgcggtgggcatcatcattaaggaaaatgcctcgatctctggcgcggaggtggggtgtcagggtgaggttggttcagcgtccgcgatggcggctgccgggttgtgtgcagtcttaggtggttctccgcaacaggtggaaaacgccgcggagattgcgttggagcacaatttgggattgacgtgcgatccggtgggcgggttagtgcagattccgtgtattgaacgcaacgctattgctgccatgaagtccatcaatgcggcaaggcttgcccggattggtgatggcaacaatcgcgtgagtttggatgatgtggtggtcacgatggctgccaccggccgggacatgctgaccaaatataaggaaacgtcccttggtggtttggcaaccaccttgggcttcccggtgtcgatgacggagtgttagcggtacggctttaacacggcttggatt

SEQ ID NO: 78 - protein, 484 aa, Corynebacterium glutamicum
VDSCNFRLLRRRWTKNNYNQADHLVHHHRKGPPSAMAISVVDLFSIGIGPSSSHTVGPMRAALTYISEFPSSHVDITLHGSLAATGKGHCTDRAVLLGLVGWEPTIVPIDAAPSPGAPIPAKGSVNGPKGTVSYSLTFDPHPLPEHPNAVTFKGSTTRTYLSVGGGFIMTLEDFRKLDDIGSGVSTIHPEAEVPCPFQKSSQLLAYGRDFAEVMKDNERLIHGDLGTVDAHLDRVWQIMQECVAQGIATPGILPGGLNVQRRAPQVHALISNGDTCELGADLDAVEWVNLYALAVNEENAAGGRVVTAPTNGAAGIIPAVMHYARDFLTGFGAEQARTFLYTAGAVGIIIKENASISGAEVGCQGEVGSASAMAAAGLCAVLGGSPQQVENAAEIALEHNLGLTCDPVGGLVQIPCIERNAIAAMKSINAARLARIGDGNNRVSLDDVVVTMAATGRDMLTKYKETSLGGLATTLGFPVSMTEC

SEQ ID NO: 79 - DNA, 1066 bp, Corynebacterium glutamicum
  CDS (101)..(1036): RXA01940
ccagaatcaatcaccgatacagtggcagccaaagtccaggctgaagaagccgctcaagccgccagctaaatccacaaactgaactaaggagttttaccctatgaccaccaagatcatcctcgactgcgatccaggacacgacgacgctgtagccatgctgctcgcagccggcagcccagaaattgaactgcttggaatcaccacggtcggcggcaaccagaccttggacaaggtcacccacaatacgcaggtcgtagccaccatcgctgatatcaatgcgcccatctaccgcggtgtcacccgaccattggtgcgccccgttgaggtagccgaagatatccacggcgataccggcatggaaatccacaagtacgaactgcctgaaccaaccaagcaggtagaagacacccacgcggtggatttcatcatcgataccatcatgaataacgagcccggcagcgtagcgctggttcccaccggaccactgaccaacatcgcgctggcagtccggaaagaaccacgcatcgccgagcgagtcaaggaagttgtcctcatgggcgggggctaccacgtaggaaactggaccgccgtagctgaattcaacatcaagatcgaccccgaagcagcccacatcgtattcaacgaaaagtggccactgactatggtcggcctcgaccttacccaccaggcgctcgcaacacctgagatcgaagccaagttcaacgagctgggcaccgacgtcgccgacttcgtcgtcgcgcttttcgacgctttccgcaagaattaccaggacgcacagggttttgataacccaccagtacacgacccttgtgctgttgcataccttgttgacccaaccgtattcaccacccgcaaagcaccactcgatgtggagctgtacggcgcactcaccacaggcatgaccgttgctgatttccgcgcaccggctccagcagattgcaccacccaagtagctgttgacctggactttgataaattctggaacatggtgatcgatgcagtaaagcgcatcggatagacctgttcacaaggttgttagagggcg

SEQ ID NO: 80 - protein, 312 aa, Corynebacterium glutamicum
MTTKIILDCDPGHDDAVAMLLAAGSPEIELLGITTVGGNQTLDKVTHNTQVVATIADINAPIYRGVTRPLVRPVEVAEDIHGDTGMEIHKYELPEPTKQVEDTHAVDFIIDTIMNNEPGSVALVPTGPLTNIALAVRKEPRIAERVKEVVLMGGGYHVGNWTAVAEFNIKIDPEAAHIVFNEKWPLTMVGLDLTHQALATPEIEAKFNELGTDVADFVVALFDAFRKNYQDAQGFDNPPVHDPCAVAYLVDPTVFTTRKAPLDVELYGALTTGMTVADFRAPAPADCTTQVAVDLDFDKFWNMVIDAVKRIG

SEQ ID NO: 81 - DNA, 1078 bp, Corynebacterium glutamicum
  CDS (101)..(1048): RXA02021
ttgggtcgccgaggagatctaatcctggtttgagttcagagttcacaggtttaagcctacaaaccttagttaaaacatgatggaagcggtcgattaaaaaatgagtgaaaacattcgcggagcccaagcagttggaatcgcaaatatcgccatggacgggaccatcctggacacgtggtacccagaaccccaaattttcaacccggatcagtgggctgaacgctacccattggaagtgggcaccacacgcctcggagcaaacgaactcaccccacggatgctgcagttggtaaaactggaccaagatcgcctcgtcgaacaggtagcagtccgcaccgttatccccgatctgtctcaacctccagtagacgcgcacgatgtttacctgcgcctccacctgctttcccaccgcctggtccgcccccacgaaatgcacatgcaaaacaccttggagctgctgtccgacgtggtgtggacaaacaagggcccttgccttcctgaaaactttgagtgggtgcgtggtgctctgcggtcccgcggactcatccacgtctactgtgtggaccgtcttccccgcatggtcgactatgtggttccccctggagtccgcatctccgaagcagaacgcgtgcgcctaggtgcataccttgctccgggtacctctgtgctgcgtgaaggtttcgtgtctttcaactccggcaccttgggtgccgcaaaggtggaaggccgcctgagttccggtgtggtcatcggtgaaggttccgagattggactgtcttctactattcagtccccgagagatgaacagcgccgccgtttgccgttgagcatcggccaaaactgcaactttggtgtcagctccggaatcatcggagtcagtctgggagacaattgcgacatcggaaataacattgtcttggatggagatacccccatttggttcgcagccgatgaggagttacgcactatcgactccatcgaaggccaagcaaattggtcaatcaagcgtgaatccggcttccatgagccagttgcccgcctcaaagcttgacccattttcataaccagtgccatgtgg

SEQ ID NO: 82 - protein, 316 aa, Corynebacterium glutamicum
MSENIRGAQAVGIANIAMDGTILDTWYPEPQIFNPDQWAERYPLEVGTTRLGANELTPRMLQLVKLDQDRLVEQVAVRTVIPDLSQPPVDAHDVYLRLHLLSHRLVRPHEMHMQNTLELLSDVVWTNKGPCLPENFEWVRGALRSRGLIHVYCVDRLPRMVDYVVPPGVRISEAERVRLGAYLAPGTSVLREGFVSFNSGTLGAAKVEGRLSSGVVIGEGSEIGLSSTIQSPRDEQRRRLPLSIGQNCNFGVSSGIIGVSLGDNCDIGNNIVLDGDTPIWFAADEELRTIDSIEGQANWSIKRESGFHEPVARLKA

SEQ ID NO: 83 - DNA, 3871 bp, Corynebacterium glutamicum
  CDS (101)..(3841): RXA02095
ctctcttggtcctctccccacccatttttaagtactcaagacccttccaacagaaaggattactcccccaacaggctcaaaaatactgaaaggctcacgcatgaaaactgagcaatcccaaaaagcacaattagcccctaagaaagcacctgaaaagccacaacgcatccgccaacttatttccgtggcgtggcagcgaccttggctcacctcattcaccgtaatcagcgctttagctgcaacgttgtttgaacttacacttcctcttttgaccggtggcgccatcgatatcgcgctcggaaataccggagatactttaaccactgacctgctggaccggttcactccgagtggattaagcgtgttgaccagcgtcattgcccttatcgtgcttctcgcgttgcttcgctatgccagtcaatttggacggcgatacaccgcaggcaagctcagcatgggggtacagcatgatgtccggcttaaaacgatgcgctcattgcagaacctcgatgggccaggtcaggactctattcgcacaggccaagtagtcagtcggtccatttcggatatcaacatggtgcaaagccttgtggcgatgttgccgatgttgatcggaaatgtggtcaagcttgtgctcactttggtgatcatgctggctatttccccgccgctgaccatcatcgctgcagtgttggtgcctttgctgttgtgggccgtggcctattcgcgaaaagcgctttttgcgtccacgtggtcggcccagcaaaaggctgcggatctgaccactcatgtggaagaaactgtcacgggtatccgcgtggtcaaggcatttgcgcaggaagaccgcgagaccgacaaattggatctcaccgcacgtgagttatttgcccagcgcatgcgcactgcacgtctgacggcaaagttcatccccatggttgagcagcttccgcagcttgctttggtggtcaacattgttggcggtggctatttggccatgactggtcacatcacggtgggcacgtttgtggcgttttcttcctatctcactagcttgtcggcggtggctaggtccctgtcgggcatgctcatgcgcgtgcagttggcgctgtcttctgtggagcgcatctttgaagtcattgatcttcagcctgaacgcaccgatcctgcacaccccctgtcacttcccgacactcccctgggtctgtcgttcaacaacgtagatttccgtgggattctcaacggttttgagctgggtgttcaggccggtgaaaccgttgtgttggtgggccctccaggttcaggcaagaccatggctgtgcagcttgctggaaacttttatcaaccagacagcggccacatcgcctttgatagcaacggccatcgcactcgcttcgacgacctcacccacagcgatatccgcaggaatctcatcgcggtttttgatgagccgttcttgtactcctcctccatccgcgagaacatctcgatgggtttggatgtcagtgatgagcagatcgaacacgcagccaggcttgcccaggctcatgattttatcgatcgccttccaaacaaatacgaggaagtcattggcgaacgcggcctgacgctttctggtggtcaacgccaacgcatcgccctcgcacgggctttcctggcgcatcccaaagtgttggtgcttgatgatgccacctctgccattgatgcctccactgaggaccgcattttccaggccttgcgcgaagaactgcacgatgtcaccattttgatcatcgcgcaccgccactccactttggagctcggcgatcgggttggtctggtcgaagatggacgggtaacagcactgggaccgttgagtgagatgcgtgatcacgctcgtttctcgcatctgatggctcttgatttccaggattctcacgatccggaattcaccctcgacaacggttcactacccagccaagagcaattgtggccggaggtctccacagaaaagcagtacaagattcttgcgcctgcccctggtcgaggccgtggcatgtccatgccagcaacccctgagctgctcgcccagattgaggcgctgccagcagcaacggaagaaacacgagttgatgccgggaggctacgcaccagtacctccggtttcaaattgctcagtttattcaagcaggtccgttggctcgtcgtcgcggtcatcgcgttgttgctggtgggcgtagccgccgatctagcatttccaacactgatgcgcgcagccatcgacaacggtgtgcaagcacaaagcacctccacgttgtggtggatcgccatcgcaggcagcgtagtagtccttctgtcctgggccgccgccgcgatcaacacgattatcacggcacgcaccggtgaacggctgctttacggcttgcgtctgcgctcatttgtgcatctattgcgcctgtccatgagctatttcgaacgcaccatgtccggccgcatcatgacgcgcatgaccaccgacatcgacaacctctcgtccttcctccaatcaggtctggcgcaaacagttgtctctgtgggcacgctcatcggtgtggtcaccatgctcgccatcaccgacgcacaactagcactcgttgcgctgtccgtggtgccgatcatcatcgtgctcactctcattttccgacgcatcagctccaggctgtacaccgcttcacgcgagcaagccagccaggtcaacgcggtattccacgagtccatcgccggtttacgcaccgcgcagatgcaccgcatggaagaccaagtctttgacaattatgcgggcgaagcagaggaattccgacgcctgcgtgtgaaatcccagacggccatcgccatctacttccccggccttggcgcgctctctgaaatcgcccaggcactcgtcctcggtttcggcgcactgcaagtaacgcgcggcgacatctccaccggcgtactcgtggcattcgtgctgtacatgggcctgatgttcggccccatccaacaactaagccaaatcttcgactcctaccaacaagccgccgtcggcttccgtcgcatcaccgaactgctcgcaacgcagcccagcgtcccagatctgggcaccaacaggcacgctaggcaggctgccacgcagcctttattgcttgacgacgtcaccttcggctattcagacgatccgatcctagacaacgtcaccgtccagatcgaaccgggaaccaccgtcgctgtggtgggaccaaccggcgctggaaaatccaccgtggtgaaactcctttcccgcctctacgaccccaatgaaggtgccgtgaaagctggcgagatcgatatcaaggacttccccaccgctgattggcgccgcacaatcggtaccgtgccacaagaagcacacttgtttagtggaagcatcgccgacaacattggctacggatgcagggaggcgtcgacaagcaaaatcgaagcggcagcacgccgcgtcggagccttaaacgccatcgccgccatccctgatggtttcaaccatcaagtcggtgaacgcgggcgcaacctgtcatccggacagcgccaactgatcgcgctggcgcgcgccgaacttatcgagccttccatcatgcttctcgacgaagccacctccaccctcgaccccgccaccgaagccgttatcctcaacgcctccgatcgagtcactaagggacgcaccagcatcatcgtcgcgcaccgcttggcaaccgctaaaagggccgaccgtattcttgttgttgaacaaggacgtatcattgaggacggatctcacgacgcgttgttgtctgctaacggcacctacgcccgcatgtggcatttaatggcctgacacgttatttttaggagaactgtcaac

SEQ ID NO: 84 - protein, 1247 aa, Corynebacterium glutamicum
MKTEQSQKAQLAPKKAPEKPQRIRQLISVAWQRPWLTSFTVISALAATLFELTLPLLTGGAIDIALGNTGDTLTTDLLDRFTPSGLSVLTSVIALIVLLALLRYASQFGRRYTAGKLSMGVQHDVRLKTMRSLQNLDGPGQDSIRTGQVVSRSISDINMVQSLVAMLPMLIGNVVKLVLTLVIMLAISPPLTIIAAVLVPLLLWAVAYSRKALFASTWSAQQKAADLTTHVEETVTGIRVVKAFAQEDRETDKLDLTARELFAQRMRTARLTAKFIPMVEQLPQLALVVNIVGGGYLAMTGHITVGTFVAFSSYLTSLSAVARSLSGMLMRVQLALSSVERIFEVIDLQPERTDPAHPLSLPDTPLGLSFNNVDFRGILNGFELGVQAGETVVLVGPPGSGKTMAVQLAGNFYQPDSGHIAFDSNGHRTRFDDLTHSDIRRNLIAVFDEPFLYSSSIRENISMGLDVSDEQIEHAARLAQAHDFIDRLPNKYEEVIGERGLTLSGGQRQRIALARAFLAHPKVLVLDDATSAIDASTEDRIFQALREELHDVTILIIAHRHSTLELGDRVGLVEDGRVTALGPLSEMRDHARFSHLMALDFQDSHDPEFTLDNGSLPSQEQLWPEVSTEKQYKILAPAPGRGRGMSMPATPELLAQIEALPAATEETRVDAGRLRTSTSGFKLLSLFKQVRWLVVAVIALLLVGVAADLAFPTLMRAAIDNGVQAQSTSTLWWIAIAGSVVVLLSWAAAAINTIITARTGERLLYGLRLRSFVHLLRLSMSYFERTMSGRIMTRMTTDIDNLSSFLQSGLAQTVVSVGTLIGVVTMLAITDAQLALVALSVVPIIIVLTLIFRRISSRLYTASREQASQVNAVFHESIAGLRTAQMHRMEDQVFDNYAGEAEEFRRLRVKSQTAIAIYFPGLGALSEIAQALVLGFGALQVTRGDISTGVLVAFVLYMGLMFGPIQQLSQIFDSYQQAAVGFRRITELLATQPSVPDLGTNRHARQAATQPLLLDDVTFGYSDDPILDNVTVQIEPGTTVAVVGPTGAGKSTVVKLLSRLYDPNEGAVKAGEIDIKDFPTADWRRTIGTVPQEAHLFSGSIADNIGYGCREASTSKIEAAARRVGALNAIAAIPDGFNHQVGERGRNLSSGQRQLIALARAELIEPSIMLLDEATSTLDPATEAVILNASDRVTKGRTSIIVAHRLATAKRADRILVVEQGRIIEDGSHDALLSANGTYARMWHLMA

SEQ ID NO: 85 - DNA, 1081 bp, Corynebacterium glutamicum
  CDS (101)..(1051): RXA02156
aaccactgacctgagcttctcctacgtggagatcaactccgcgtacagctcttaaaaagaaacagcactccaactaacaagcagggaaaagggcacaggcatgaatgacttgatcaaagatttaggctctgaggtgcgcgcaaatgtcctcgctgaggcgttgccatggttgcagcacttccgcgacaagattgttgtcgtgaaatatggcggaaacgccatggtggatgatgatctcaaggctgcttttgctgccgacatggtcttcttgcgcaccgtgggcgcaaaaccagtggtggtgcacggtggtggacctcagatttctgagatgctaaaccgtgtgggtctccagggcgagttcaagggtggtttccgtgtgaccactcctgaggtcatggacattgtgcgcatggtgctctttggtcaggtcggtcgcgatttagttggtttgatcaactctcatggcccttacgctgtgggaacctccggtgaggatgccggcctgtttaccgcgcagaagcgcatggtcaacatcgatggcgtacccactgatattggtttggtcggagacatcattaatgtcgatgcctcttccttgatggatatcatcgaggccggtcgcattcctgtggtctctacgattgctccaggcgaagacggccagatttacaacattaacgccgataccgcagcaggtgctttggctgcagcgattggtgcagaacgcctgctggttctcaccaatgtggaaggtctgtacaccgattggcctgataagagctcactggtgtccaagatcaaggccaccgagctggaggccattcttccgggacttgattccggcatgattccaaagatggagtcttgcttgaacgcggtgcgtgggggagtaagcgctgctcatgtcattgacggccgcatcgcgcactcggtgttgctggagcttttgaccatgggtggaattggcacgatggtgctgccggatgtttttgatcgggagaattatcctgaaggcaccgtttttagaaaagacgacaaggatggggaactgtaaatgagcacgctggaaacttggccacag

SEQ ID NO: 86 - protein, 317 aa, Corynebacterium glutamicum
MNDLIKDLGSEVRANVLAEALPWLQHFRDKIVVVKYGGNAMVDDDLKAAFAADMVFLRTVGAKPVVVHGGGPQISEMLNRVGLQGEFKGGFRVTTPEVMDIVRMVLFGQVGRDLVGLINSHGPYAVGTSGEDAGLFTAQKRMVNIDGVPTDIGLVGDIINVDASSLMDIIEAGRIPVVSTIAPGEDGQIYNINADTAAGALAAAIGAERLLVLTNVEGLYTDWPDKSSLVSKIKATELEAILPGLDSGMIPKMESCLNAVRGGVSAAHVIDGRIAHSVLLELLTMGGIGTMVLPDVFDRENYPEGTVFRKDDKDGEL

SEQ ID NO: 87 - DNA, 1561 bp, Corynebacterium glutamicum
  CDS (101)..(1531): RXA02162
gatcgctaacaagcgcgatcgcgaagctggcaacaactaagccaccttttcaagcatccagactagaacttcaagtatttagaaagtagaagaacaccacatggaacagcacggaaccaatgaaggtgcgctgtggggcggccgcttctccggtggaccctccgaggccatgttcgccttgagtgtctccactcatttcgactgggttttggccccttatgatgtgttggcctccaaggcacacgccaaggttttgcaccaagcagatctactttctgatgaagatctagccaccatgctggctgggcttgatcagctgggcaaggatgtcgccgacggaaccttcggtccgctgccttctgatgaggatgtgcacggcgcgatggaacgcggtctgattgaccgcgttggtcctgaggtgggcggccgtctgcgcgctggtcgttcccgcaacgaccaggtggcaaccctgttccgcatgtgggtccgcgacgcagtgcgcgacatcgcgctgggaacaaccgagcttgtcgacgccctcagcgcccaagctaaggcacatgcaggcgcgatcatgccaggcaagacccacttccaggcagctcagccggtccttctggcacaccagctgctggcacacgcacagcctttgctgcgcgatattgatcgtatccgtgacctggacaagcgtcttgcggtgtctccttacggttccggcgcacttgctggttcctctttgaagctcaaccctgaagcaatcgctgaagaactcggctttgattccgcagcagataactccattgatgccaccagctcccgcgatttcgcatctgaaaccgccttcgtgctggcgcagcttgcagtggatatgtcccgcttggctgaagaaatcatcgcatggtgcaccccagaatttggttacatcaccttgtctgattcctggtccacaggcagctcaatcatgccgcagaagaagaaccctgacgtggcagagctgacccgtggcaagtctggtcgcttgatcggtaacctcaccggtctgctggctaccctgaaggcacagcctttagcgtacaaccgcgacctgcaggaagataaggaaccaatcgtagattccgtggcgcagctcaacctgctgctccctgcaatgactggtttggtttccaccttgaccttcaacaccgagcgcatgcgtgaacttgcaccagcaggtttcacccttgccaccgacttggctgagtggatggtgcgccagggcgttccattccgtgaggcacacgaagcatccggcgcttgcgtgcggatcgcggagtccaggggagtggaccttatcgatctcactgatgaagaactcagtggcgttgatgcacgtctgaccccagaggtacgggaagtgctcaccattgatggtgcagtggcttcccgtgcaacgcgcggtggaaccgcgggcgtgcgggttgcggagcaacgcgcacgtgtcgatgccgcaagtaccgctcacgcggagtgggcacgtgcgggggtacgtcgataagcattagtttatggcctgtgctgcttt

SEQ ID NO: 88 - protein, 477 aa, Corynebacterium glutamicum
MEQHGTNEGALWGGRFSGGPSEAMFALSVSTHFDWVLAPYDVLASKAHAKVLHQADLLSDEDLATMLAGLDQLGKDVADGTFGPLPSDEDVHGAMERGLIDRVGPEVGGRLRAGRSRNDQVATLFRMWVRDAVRDIALGTTELVDALSAQAKAHAGAIMPGKTHFQAAQPVLLAHQLLAHAQPLLRDIDRIRDLDKRLAVSPYGSGALAGSSLKLNPEAIAEELGFDSAADNSIDATSSRDFASETAFVLAQLAVDMSRLAEEIIAWCTPEFGYITLSDSWSTGSSIMPQKKNPDVAELTRGKSGRLIGNLTGLLATLKAQPLAYNRDLQEDKEPIVDSVAQLNLLLPAMTGLVSTLTFNTERMRELAPAGFTLATDLAEWMVRQGVPFREAHEASGACVRIAESRGVDLIDLTDEELSGVDARLTPEVREVLTIDGAVASRATRGGTAGVRVAEQRARVDAASTAHAEWARAGVRR

SEQ ID NO: 89 - DNA, 1270 bp, Corynebacterium glutamicum
  CDS (101)..(1240): RXA02176
gtgaagaatctagggtgctaggaactgacagcttcagggttatagttgttgggtcagatcgttaacgatccctggcccttttacttccaagcgcagaaagttgcccgaagacatgaccgacttccccaccctgccctctgagttcatccctggcgacggccgtttcggctgcggaccttccaaggttcgaccagaacagattcaggctattgtcgacggatccgcatccgtcatcggtacctcacaccgtcagccggcagtaaaaaacgtcgtgggttcaatccgcgagggactctccgacctcttctcccttccagaaggctacgagatcatcctttccctaggtggtgcgaccgcattctgggatgcagcaaccttcggactcattgaaaagaagtccggtcacctttctttcggtgagttctcctccaagttcgcaaaggcttctaagcttgctccttggctcgacgagccagagatcgtcaccgcagaaaccggtgactctccggccccacaggcattcgaaggcgccgatgttattgcatgggcacacaacgaaacctccactggcgccatggttccagttcttcgccccgaaggctctgaaggctccctggttgccattgacgcaacctccggcgctggtggactgccagtagacatcaagaactccgatgtttactacttctccccacagaagtgcttcgcatccgacggtggcctgtggcttgcagcgatgagcccagcagctctcgagcgcatcgagaagatcaacgcttccgatcgcttcatccctgagttcctcaacctgcagaccgcagtggataactccctgaagaaccagacctacaacaccccagctgttgctaccttgctgatgctggacaaccaggtcaagtggatgaactccaacggcggcctggatggaatggttgctcgcaccacagcaagctcctccgccctgtacaactgggctgaggctcgcgaggaggcatccccatacgtggcagatgcagctaagcgctccctcgttgtcggcaccatcgacttcgatgactccatcgacgcagcagtgatcgctaagatactgcgcgcaaacggcatcctggacaccgagccttaccgcaagctgggacgcaaccagctgcgcatcggtatgttcccagcgatcgattccaccgatgtggaaaagctcaccggagcaatcgacttcatcctcgatggcggttttgcaaggaagtaatacccccactttgaaaaacaccccgta

SEQ ID NO: 90 - protein, 380 aa, Corynebacterium glutamicum
LPEDMTDFPTLPSEFIPGDGRFGCGPSKVRPEQIQAIVDGSASVIGTSHRQPAVKNVVGSIREGLSDLFSLPEGYEIILSLGGATAFWDAATFGLIEKKSGHLSFGEFSSKFAKASKLAPWLDEPEIVTAETGDSPAPQAFEGADVIAWAHNETSTGAMVPVLRPEGSEGSLVAIDATSGAGGLPVDIKNSDVYYFSPQKCFASDGGLWLAAMSPAALERIEKINASDRFIPEFLNLQTAVDNSLKNQTYNTPAVATLLMLDNQVKWMNSNGGLDGMVARTTASSSALYNWAEAREEASPYVADAAKRSLVVGTIDFDDSIDAAVIAKILRANGILDTEPYRKLGRNQLRIGMFPAIDSTDVEKLTGAIDFILDGGFARK

SEQ ID NO: 91 - DNA, 973 bp, Corynebacterium glutamicum
  CDS (101)..(943): RXA02194
gaaatctcccagctcatttattggacccaggtcatcatggttgctcgcggcctgaagccagaagatatctacaagaacctgtaggagttttaaagcaatcatgttgaaaatcgctgtcccaaacaaaggctcgctgtccgagcgcgccatggaaatcctcgccgaagcaggctacgcaggccgtggagattccaaatccctcaacgtttttgatgaagcaaacaacgttgaattcttcttccttcgccctaaagatatcgccatctacgttgctggtggccagctcgatttgggtatcaccggccgcgaccttgctcgcgattcccaggctgatgtccacgaagttctttccctcggcttcggttcctccactttccgttacgcagcaccagctgatgaagagtggagcatcgaaaagctcgacggcaagcgcatcgctacctcttaccccaaccttgttcgcgatgacctcgcagcacgtgggctttccgctgaggtgctccgcctcgacggtgcagtagaggtatccatcaagcttggtgtcgcagatgccatcgccgatgttgtatccaccggccgcacgctgcgtcagcaaggtcttgcacctttcggcgaggttctgtgcacctctgaggctgtcattgttggccgcaaggatgaaaaggtcaccccagagcagcagatcctgcttcgccgcatccagggaattttgcacgcgcagaacttcctcatgctggattacaacgtcgaccgcgacaacctggacgctgccactgcagtaaccccaggcttatccggcccaacggtatccccactggcacgcgacaactgggttgctgtacgcgccatggtgccacgcaggtcagctaacgccatcatggataagcttgctggactcggcgctgaagccatcctggcttctgaaatccgcatcgcccgcatctagttttaactacccccgaaaatgtagtgg

SEQ ID NO: 92 - protein, 281 aa, Corynebacterium glutamicum [sequence omitted]

SEQ ID NO: 93 - DNA, 1198 bp, Corynebacterium glutamicum
  CDS (101)..(1168): RXA02206
gccggcatcggcaccccagaacagctcagagatgattcggaggtgtccgctggagctgatcggcaggaactctgtgaggccttgaacgatggagagcacaatggtttgtacccagccaatattttcagttgcggcaggatctgctgctgcggctaggagggttatctcttcattcacccgatctaccgtactaccttatgacctcagtagtgtggtgggcgtgaaacagcgaatggtcggttcaagtggtttgcgggtatccaggctcggtttgggcacctcaacatggggctcgggcaccgagctggctgaggcaggcgatatctttaaggcgttcatcaattctggtggcacgcttatcgacgtctcccccaactacaccaccggcgtcgcggaagaaatgctcggcacgatgttggatgcggaagtctctcgttcggctgtcgtcatttcctccagcgcaggtgtcaaccccgctctgccgctcggccgacgtgtggattgctcccgccgcaatttgattgcccaattagatgtcaccctgcgggcattaaacactgactatttggatttgtggtctgtgggctattgggatgagggcaccccaccgcatgaggtggccgatactttggattacgccgtgcgcaccggccgagtccgatatgccggtgtccgaggatattccggttggcagttagcggtcacccacgctgcatccaatcatgcagcggcctccgcccgccccgtggtcgttgcacaaaatgaatacagcctgctggaacgccgcgcagaacaagaactcctccctgccacccaacacctaggtgtcggattctttgctggcgctccgctggggcaaggcgtgctgactgctaaataccgctccgaaattccccatgattccagagctgcatccacaggacgcgacgcagaagtccaaagctacctagataatcgaggccgcatcattgtcgatgctcttgatactgcagccaaaggattaggcattagccccgctgtcacagccaccacctgggtgcgtgatcgtcccggagtgacagctgtcatcgtgggcgctcgcacacatgaacagctgtcacatcttctcaaggcggaatcggtgactttgccaacaccaatcacacaagcccttgatgatgtctccctgtgacttggtccaattacattcactggtaat

SEQ ID NO: 94 - protein, 356 aa, Corynebacterium glutamicum
MVCTQPIFSVAAGSAAAARRVISSFTRSTVLPYDLSSVVGVKQRMVGSSGLRVSRLGLGTSTWGSGTELAEAGDIFKAFINSGGTLIDVSPNYTTGVAEEMLGTMLDAEVSRSAVVISSSAGVNPALPLGRRVDCSRRNLIAQLDVTLRALNTDYLDLWSVGYWDEGTPPHEVADTLDYAVRTGRVRYAGVRGYSGWQLAVTHAASNHAAASARPVVVAQNEYSLLERRAEQELLPATQHLGVGFFAGAPLGQGVLTAKYRSEIPHDSRAASTGRDAEVQSYLDNRGRIIVDALDTAAKGLGISPAVTATTWVRDRPGVTAVIVGARTHEQLSHLLKAESVTLPTPITQALDDVSL

SEQ ID NO: 95 - DNA, 700 bp, Corynebacterium glutamicum
  CDS (101)..(670): RXA02237
gacgagctgggcattgctcagacccgtcgtcttcgtggactgggtgaccgtcagcgtcgcgcacttctcgagcgtttcggcttcgaggattaattcttcagtgtcgggcgataaccaactaggacggctcgtaattcttgcgggcccctcagcggtcggtaaatcgactgtggttgatcgcctccgcaatgacgttccaaacctgtatttcagtgtgtcgatgaccactagggcacctcgtcctggtgaagtcgatggacgtgactacttctatgtcactgcacaggaatttcaggacaaaatcgactgtggagagatgcttgaatgggcagatatccacggcggtttgcagcgttcaggcactccagcaggtcccgtcaatgaggctcgccaaaatggtcggccagtattggttgaggttgatcttgcaggagcccgaaacatcgctagcttaattccagatgcagaaaccatcttccttgctccaccttcatgggaagttttggttgaacgcctcactggacgtggcaccgaaagcgaagacgttattgctcgcaggctcgagaccgcacgcgaagaattggctgctcagagcgaatttaagcacgtcattatcaatgatgatgtggatacagccgtcaaggctattgaggatgttctcctcggcgcttagccaaaacatagagcggtagggtatgct

SEQ ID NO: 96 - protein, 190 aa, Corynebacterium glutamicum
VSGDNQLGRLVILAGPSAVGKSTVVDRLRNDVPNLYFSVSMTTRAPRPGEVDGRDYFYVTAQEFQDKIDCGEMLEWADIHGGLQRSGTPAGPVNEARQNGRPVLVEVDLAGARNIASLIPDAETIFLAPPSWEVLVERLTGRGTESEDVIARRLETAREELAAQSEFKHVIINDDVDTAVKAIEDVLLGA

SEQ ID NO: 97 - DNA, 1396 bp, Corynebacterium glutamicum
  CDS (101)..(1366): RXA02239
ctatgcacagcggaggtcgagggagagcgtggggtggcgtcgaaaagcatcttgtagagtgtgtgggaacccagccagcctcttactttgaaggattgttgtgcccatgactcatgtttcaagcccctccgcaccccgcaacgtggttgttggtgttgccggcggaatcgcagcgtacaaggcgtgtcacatcgtgcgcgcgtttaaagaagcgggcgataatgtgcgggtggttcctacggaatccgcgttgaagtttgtggggaaggcgacgtttgaagcgttgtctggcaatccggtgtctacaacggtgtttgatgcggtggattcggtgcagcatgtgaaagttggccaggaggctgatttgatcgtgattgcgccggcgacagccgatttgatggcgcgtgtggtggcaggtcgcggtgacgatctgttggcggcgacgctgctggtggcaacgtgccccgtggttattgcgccggccatgcatacggagatgtggtttaatccggctaccgtagccaatgtggcaacgctgaggcagcgggggattaccgtgattgagcctgcgcatggtcgactcaccggtaaagatacaggccctggccggctgccggatccagagcagattgttgatttagccaatgcggtgcacgccggggcgaggttgcctcaggatttggcgggcaagaaagtgctgatcactgctggtggcacgcatgagcatattgatcctgtgcgctttattggcaatagttcctcgggccgtcaaggttttgcgttgggtgaaatcgcagcacagcgaggtgctcatgtcagcatcgtggcgggaaatgctgcggagctgcccactccggcaggcgcagagatcgtgccggtggtgtccacacaagacatgtttgatgcagtccaggaacgagctggccaatctgatttcatcgtcatggcggcagcggtagctgatttcacgcccgcatcgcaggcgacatcgaagttgaagaagggctcagattctgatgaagacgcattgagcaccatctcgttggtggaaaacccggatattttggctaccacggtgaagcgtcgtgaagcaggagagctggacagtaatcctgtcatcgtgggttttgctgcggaaactggagacgagcacaccaccgccttggagtatgcgcgcaagaaactgcagaagaagggctgcgacctcctcatgtgtaatgaggtgggcatgggcaaagtgtttgggcaaaagcacaatgagggctggattttggatgctcacggtggggtagtcgatgtggagcacggcagcaaaatcgaggttgctgcgcaaatttgggacgcggcactggcgtatcgcgaagtctagaaaaatccagctagaccactgacattg

SEQ ID NO: 98 - protein, 422 aa, Corynebacterium glutamicum
VPMTHVSSPSAPRNVVVGVAGGIAAYKACHIVRAFKEAGDNVRVVPTESALKFVGKATFEALSGNPVSTTVFDAVDSVQHVKVGQEADLIVIAPATADLMARVVAGRGDDLLAATLLVATCPVVIAPAMHTEMWFNPATVANVATLRQRGITVIEPAHGRLTGKDTGPGRLPDPEQIVDLANAVHAGARLPQDLAGKKVLITAGGTHEHIDPVRFIGNSSSGRQGFALGEIAAQRGAHVSIVAGNAAELPTPAGAEIVPVVSTQDMFDAVQERAGQSDFIVMAAAVADFTPASQATSKLKKGSDSDEDALSTISLVENPDILATTVKRREAGELDSNPVIVGFAAETGDEHTTALEYARKKLQKKGCDLLMCNEVGMGKVFGQKHNEGWILDAHGGVVDVEHGSKIEVAAQIWDAALAYREV

SEQ ID NO: 99 - DNA, 709 bp, Corynebacterium glutamicum
  CDS (101)..(679): RXA02250
caactgagggttagactgttctttaaaaggtttgacgcctcggtttaatgcctagcaggatgcgcgccaccgctaattagttctaaggatttgtgaaatcgtgacaaccaacgcccccgacggagcaacgaacaacatcaacaacgcacattcgggcgctgtcgggaagccaaaggtacagctcagcgatgcggaaattcaggaatacaccgcagctttcgctggcaccaccacaaccaagccatgggagctggaggtgaccacaaagtttctgaaaaagatcgcgtgggtagccgtggttgtcatcatggccgttcacatcttcatgggtgccgtggtggacgtcgatttcaccggtgcagcggtcacctttgttgacactctggcattcccagcgttgggcatcatcttctccgttcttgtgttcttgggactgactcgccctcgcgtgcgtgccaacgaagacggcgttgaggtgcgtaacttcatcggaactcgtttctacccatgggttgtcatctacggcatgtctttccccaagggcagcagcgtggcacgtttggagcttccagactttgaattcgttcccatgtgggctttccagtcccgcgatggagaagatgtggtgcgcgcggttgcgaccttccgcgacctcgaaaacaagtacatgccagaggactaattaagctgtggctgatccaacaactta

SEQ ID NO: 100 - protein, 193 aa, Corynebacterium glutamicum
VTTNAPDGATNNINNAHSGAVGKPKVQLSDAEIQEYTAAFAGTTTTKPWELEVTTKFLKKIAWVAVVVIMAVHIFMGAVVDVDFTGAAVTFVDTLAFPALGIIFSVLVFLGLTRPRVRANEDGVEVRNFIGTRFYPWVVIYGMSFPKGSSVARLELPDFEFVPMWAFQSRDGEDVVRAVATFRDLENKYMPED

SEQ ID NO: 101 - DNA, 910 bp, Corynebacterium glutamicum
  CDS (101)..(880): RXA02295
ttcccatgctaatccgcgaaaatggcacttcaacagccatatactttaaacaacacaaatgatgcaagactgataccgggatgtgataggagcgcaccacatggggttggaattagcagctagcgggtggggcatcctcatcgcaggcgccgccgtagccggatggatcgacgcagtaatcggcggtggcggactcgtcctcatcccgctgatcctcgcggtcatgccgcaactcgcacctgtgacagcgctggcctccaacaaactggcagccgtcaccggcacggcatcggcggcattcaccctggtcaggcgcgtcaaacccgacaaaaaactgcttgcgctctacgttctggtggcagctgtgtgctccggtgcaggcgccctggctgcgagtctcattgacaaacaaatcatgcgaccgctgatcatcgtgttgatgctggtcgttggcctgatcgtggtgttcaaaccaaacttcggaaccggcgaaagcaaagccctgcccaccggatggaaacgctgggccgccatcgttgcagtcggactcatcgcagcctacgacggcatcttcggacccggaaccggcatgttcctcatcatggcgttcaccgcactgctctcccaaaatttcctgtcctccgcagccatggcgaaggtcgtaaacaccgcaacaaacctgggtgcgctaattgtattcatcatcggcggccacatgtggtggaccctaggactcgtgctggcagtcgccaatgtcgcaggcgcacaactcggtgcccgaacggtgcttggtggcggtaccaggctaattagatacgcactactaaccctggttgtcgtcatgagcgtctacctcacctggcaacaaatccaaggaatgtagataagtcggggcaaactctaagaaatc

SEQ ID NO: 102 - protein, 260 aa, Corynebacterium glutamicum
MGLELAASGWGILIAGAAVAGWIDAVIGGGGLVLIPLILAVMPQLAPVTALASNKLAAVTGTASAAFTLVRRVKPDKKLLALYVLVAAVCSGAGALAASLIDKQIMRPLIIVLMLVVGLIVVFKPNFGTGESKALPTGWKRWAAIVAVGLIAAYDGIFGPGTGMFLIMAFTALLSQNFLSSAAMAKVVNTATNLGALIVFIIGGHMWWTLGLVLAVANVAGAQLGARTVLGGGTRLIRYALLTLVVVMSVYLTWQQIQGM

SEQ ID NO: 103 - DNA, 538 bp, Corynebacterium glutamicum
  CDS (101)..(508): RXA02299
acgcgggggttgttgccggatcgaaatattcctttccttgtcatctcacgctatgatttctaaaacttgcaggacaacccccataaggacaccacaggacatgctgcgcaccatcctcggaagtaagattcaccgagccactgtcactcaagctgatctagattatgttggctctgtaaccatcgacgccgacctggttcacgccgccggattgatcgaaggcgaaaaagttgccatcgtagacatcaccaacggcgctcgtctggaaacttatgtcattgtgggcgacgccggaacgggcaatatttgcatcaatggtgccgctgcacaccttattaatcctggcgatcttgtgatcatcatgagctaccttcaggcaactgatgcggaagccaaggcgtatgagccaaagattgtgcacgtggacgccgacaaccgcatcgttgcgctcggcaacgatcttgcggaagcactacctggatccgggcttttgacgtcgagaagcatttagcgttttagctcgccaatattgctgccg

SEQ ID NO: 104 - protein, 136 aa, Corynebacterium glutamicum
MLRTILGSKIHRATVTQADLDYVGSVTIDADLVHAAGLIEGEKVAIVDITNGARLETYVIVGDAGTGNICINGAAAHLINPGDLVIIMSYLQATDAEAKAYEPKIVHVDADNRIVALGNDLAEALPGSGLLTSRSI

SEQ ID NO: 105 - DNA, 1426 bp, Corynebacterium glutamicum
  CDS (101)..(1396): RXA02382
gagcagatggccaccgaggtcgatgtggtggctggctactaggccttttatggtgtgatccgacactgttgcttcttaagggtctgtatagtgggcaaccatgagttcaacgaccctaactgatgaccaaattcgcgacaatgagcggaccgaagttctagctaaagcaactgcagctaagaacatcgtcccggatattgcagtgttgggcaccggaccgaagaacgcaatcctgcgtgcggcggcagatgaactcgttgcacgcagcgcagaaatcatcgaagccaacgcttccgatatcgaagcgggtcgcgcaaacggcatggaagaatccatgattgatcgccttgcccttgatgaatctcgcattgagggcatcgctggcggtttgcgccaggttgctggcctgaccgacccagtgggtgaagtactgcgcggacatgtcatggaaaacggcattcagatgaagcaggtccgtgtgcctttgggcgtgatgggcatggtctatgaagcccgccctaacgtcaccgtcgacgccttcggcctggcactcaagtccggaaacgtagctttgctgcgcggttcctccacagctgtgcattccaacaccaagctcgtggaaatcctgcaggacgtcctcgagcgtttcgagctgccacgcgaaaccgtgcagttgctgccttgccaaacccgcggatccgtccaagatttgatcaccgcacgcggcctcgttgacgtggtcatcccacgcggcggcgcaggactaatcaacgcagtggtcaccggtgcgaccgtgcccaccattgaaaccggcaccggcaactgccacttctacatcgatgccgaagccaagcttgatcaggcaatcgccatggtcatcaacggcaagacccgccgctgcagcgtgtgcaacgctactgaaaccgcgcttctcgacgccgccctcagcgactcagacaagcttgcagtcgtccaggcgctccaggaagcaggagtcacaattcatggacgggtggccgaattggaagcattcggtgcaaccgacgtggtggaagcaactgaaactgactgggattctgagtacctgtccttcgatatcgctgtcgctgtggttgacggtgtggatggagctctggcacacatcgctaagtacagcaccaagcacaccgaagcgatcgccacccaaaacattgaaaccgctcagcgctttgcagatcgcgtcgatgcagcagcggtgatgataaacgcatccaccgcctacaccgatggggagcagtacggcatgggcgcggagatcggcatttccacccagaaactgcatgcacgtggaccaatggccctgccagagctgacctccaccaagtggattctgcagggcacaggacaaattaggccttaagtttgaagaagtaatcaagctcccctg

SEQ ID NO: 106 - protein, 432 aa, Corynebacterium glutamicum
MSSTTLTDDQIRDNERTEVLAKATAAKNIVPDIAVLGTGPKNAILRAAADELVARSAEIIEANASDIEAGRANGMEESMIDRLALDESRIEGIAGGLRQVAGLTDPVGEVLRGHVMENGIQMKQVRVPLGVMGMVYEARPNVTVDAFGLALKSGNVALLRGSSTAVHSNTKLVEILQDVLERFELPRETVQLLPCQTRGSVQDLITARGLVDVVIPRGGAGLINAVVTGATVPTIETGTGNCHFYIDAEAKLDQAIAMVINGKTRRCSVCNATETALLDAALSDSDKLAVVQALQEAGVTIHGRVAELEAFGATDVVEATETDWDSEYLSFDIAVAVVDGVDGALAHIAKYSTKHTEAIATQNIETAQRFADRVDAAAVMINASTAYTDGEQYGMGAEIGISTQKLHARGPMALPELTSTKWILQGTGQIRP

SEQ ID NO: 107 - DNA, 799 bp, Corynebacterium glutamicum
  CDS (101)..(769): RXA02390
gctggtggtgctgacccatacgctggaactccaactgctgttgataccgccaagatgtttggccgcgaggatctcgtagctcgcttcgagtcataggccggtggagtggaccgcttttggcaccctgattctgctcaatttggtgggcagtttatccccggggcctgatacctttttcctcctccgcttagccacccgctccagagcgcacgcgatcgctggcgtcgccggcatcgtcaccggactcacggtgtgggtgacgctgacggtcgtgggagcagcggcgctgctcaccacttatccgtcgattctcggaatcatccagctcgtcggcggcacgtacctaagcttcattgggtacaagttgctgcgctcggcgtcgagagagcttatcgacgcccgccagttccgtttcaacgccgatgcccgacctatcccggatgcggtagaagcactgggaacccgcactcaggtatatcgacaaggtttggccaccaacctgtcaaaccctaaagttgtcatgtacttcgcggcaattctggctccgttgatgccagcgcacccatcaccggtgctggcgttctctatcatcgtggcgattttagtgcagacctttgttaccttctctgctgtgtgcctcattgtctctacggagcgtgtgcgcaaagcaatgctgcgtgcaggtccctggtttgacctgcttgctggcgttgtcttcctcgttgtgggtgtgactctgctgtatgaaggcctgaccggtttactcgggtaaaggcataaaaaatggcttccaatcaaa

SEQ ID NO: 108 - protein, 223 aa, Corynebacterium glutamicum
VEWTAFGTLILLNLVGSLSPGPDTFFLLRLATRSRAHAIAGVAGIVTGLTVWVTLTVVGAAALLTTYPSILGIIQLVGGTYLSFIGYKLLRSASRELIDARQFRFNADARPIPDAVEALGTRTQVYRQGLATNLSNPKVVMYFAAILAPLMPAHPSPVLAFSIIVAILVQTFVTFSAVCLIVSTERVRKAMLRAGPWFDLLAGVVFLVVGVTLLYEGLTGLLG

SEQ ID NO: 109 - DNA, 991 bp, Corynebacterium glutamicum
  CDS (101)..(961): RXA02499
tttgcgcacctcacgtgatggtttcagcatggttctcgcaggaatcgtgggcctggtcatgacgttcgggccgctggcaatcgtcatgtaatttgtcgttttgggcccccgctgctgcaaaacaggggtggttagtggcagtgtgggaaccatgacaacaattgctgtaatcggcggcggacaaatcggcgaggctttagtctcaggtttgatcgcggccaacatgaatccacaaaatattcgcgtcaccaaccgttcggaagagcgcggccaagagctgcgtgaccgctacggcatcctcaacatgacggataattcccaagccgcagacgaagccgacgtggtgttcctgtgcgtgaagccgaaatttatcgtcgaagtgctctccgaaatcaccggcactttggataacaactccgcacaaagtgttgtggtcagcatggccgcaggcatcagcatcgctgccatggaagaaagcgcctctgcggggctccccgtcgtgcgcgtcatgccgaacactccaatgctcgtgggcaagggcatgtcgactgtcaccaaaggccgctacgttgacgcggaacagttggaacaagtcaaggacttgttgagcaccgttggagacgtcctcgaagtcgcggaatcagacatcgacgcagtcaccgcgatgtccggatcctcccctgcatacctgttccttgtgaccgaagcgctcattgaggcaggagttaatctaggcctgccccgcgcgaccgctaaaaagctcgctgtggcctcattcgaaggtgctgcaaccatgatgaaggaaaccggcaaagaaccctcagaattgcgcgcaggcgtttcctcacccgcaggcaccaccgtcgcagccatccgagaactcgaagaaagcggaatccgaggcgctttctaccgcgcagcccaagcttgcgccgaccgatctgaagaactcggaaagcgctagaaaccgttatttccccgttatcagctc

SEQ ID NO: 110 - protein, 287 aa, Corynebacterium glutamicum
LGPRCCKTGVVSGSVGTMTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKR

SEQ ID NO: 111 - DNA, 1441 bp, Corynebacterium glutamicum
  CDS (101)..(1411): RXA02516
ttgatgatcacccactacaagcgcatcctcaactacgttaagcctgacttcattcacgttttcgcgaatggccagattgtgaccaccggtggcgctgagcttgctgacaagctcgaggctgacggctacgaccagttcatcaagtaacatgtccgatttcctcaatgcagatggatccctcaatgtggataaggtgcgggaagaattcccaatcctgaagcgcactgttagggatgggaaaccgcttgcttacctggactcaggtgcgacatcgcagcgacccgagcgggtgtggcgtgcagaggagcactttgtgctgcacaccaacgcccccgtgcaccgcggtgcctaccaactggctgaggaagcaacggatgcttatgaaggtgcccgcgagaagatcgctgcctttgttggtgccgagcagcatgaaattgcgttcactaagaatgcaactgaagcactcaatcttgttgcgtacaccttgggtgatgaccgttccggtaagtatcgtgtccaggccggggataccgtggtcatcacggagctagagcaccacgcaaacttggtgccatggcaggagctgtgccgtcgaaccggtgcgacattgaagtggtacaaggtgactgaagatggtcgcattgatctcgattcactcgagcttgatgaaactgtcaaggtcgttgccttcactcaccagtccaatgtgaccggtgctgtggctgatgttccagagttggttcgtcgtgccaaggctgtcggcgctctcacggtgcttgatgcgtgccagtctgttcctcatatgccagtgaatttccacgagctggatgtagatttctctgcattctctggccataagatgctgggacctgcaggcgtgggcgttgtgtatgcaaagtccccaatcttggatgaactgccaccatttttgactggtggttccatgattgaagttgtcaccatggagggttccacctacgctgccgcacctcaacgttttgaggccggcacgcagatgaccagccaggttgtgggcttgggtgctgccgtggacatgctgaatgaaatcggtatggaagcaatcgcagcgcatgagcacgcattgactgcttacgcgttggaaaagctcacggcaattaagggactaaccattgctggtcctttgactgcagagcagcgcggcggtgcaatcagcttcggtgtcgagggcattcacccacacgatctaggccaagtgcttgacgatcagggcgtgaatatccgcgtcggccaccactgcgcgtggcccgtgcaccgcagcatgaacgtacaatcgacagcaagagcatctttctatctctataacaccttcgaagaaatcgaccgcctcgcggcagcgatcgagaaggccaagcaattctttggagttgagtaatgaaccttgagcagatgtaccaggagg

SEQ ID NO: 112 - protein, 437 aa, Corynebacterium glutamicum
LLTSSRLTATTSSSSNMSDFLNADGSLNVDKVREEFPILKRTVRDGKPLAYLDSGATSQRPERVWRAEEHFVLHTNAPVHRGAYQLAEEATDAYEGAREKIAAFVGAEQHEIAFTKNATEALNLVAYTLGDDRSGKYRVQAGDTVVITELEHHANLVPWQELCRRTGATLKWYKVTEDGRIDLDSLELDETVKVVAFTHQSNVTGAVADVPELVRRAKAVGALTVLDACQSVPHMPVNFHELDVDFSAFSGHKMLGPAGVGVVYAKSPILDELPPFLTGGSMIEVVTMEGSTYAAAPQRFEAGTQMTSQVVGLGAAVDMLNEIGMEAIAAHEHALTAYALEKLTAIKGLTIAGPLTAEQRGGAISFGVEGIHPHDLGQVLDDQGVNIRVGHHCAWPVHRSMNVQSTARASFYLYNTFEEIDRLAAAIEKAKQFFGVE

SEQ ID NO: 113 - DNA, 1276 bp, Corynebacterium glutamicum
  CDS (101)..(1246): RXA02532
agataccgactttgctaatcccaccaccgtagccactaggtatttagttgccttggacaagcgtgtacctcgtgcttgatataacaagtaaggaagcctgatgaatttttacccaccatctgtacctattaaccctgcgtggcgtccacccacagtaactgtgcaagcgggacggccagccagaactcctggtgcgccgatgaacccacctatcacgttgtccagcacttatgttcatgattcagaaaaagcttatgggcgcgatggcaatgatggatggggtgcatttgaggctgccatgggaactctagatggtgggttcgcggtatcttattcttcaggtttggcagcggcaacgtcgattgctgatttggttcctactggtggcacagttgttttacctaaagctgcctattatggcgtgaccaatattttcgccaggatggaagcccgcggaaggctgaaggttcgaactgttgatgcagacaataccgaagaagtgattgctgctgctcaaggtgcagatgtggtgtgggtggaatcgatcgctaatccgacgatggtggtagctgatatccctgcaatagtcgacggtgtgcgtgggcttggagttttgactgtcgttgacgcgactttcgcaacgccacttcgtcaacgtccattggaacttggtgctgatattgtgctttactcggcaaccaaacttatcggtggacactctgatcttcttcttggagtcgcagtgtgcaagtctgagcaccatgcgcagtttcttgccactcaccgtcatgatcatggttcagtgccgggaggtcttgaagcgtttcttgctctccgtggattgtattccttggcggtgcgtcttgatcgagcagaatccaacgcagcagaactttcgcggcgacttaacgcgcatccttcggttacccgcgtcaattatccaggacttcctgatgatccccaacatgaaaaagccgtgcgagtcctaccctctggatgtggaaacatgttgtcatttgagcttgatgcaacacctgaacgaactgatgagattctcgaaagcctgtcacttttaacccacgcgaccagttggggaggtgtggaaacagccattgaacgtcgcaccaggcgggatgctgaagtggtggcaggagtaccgatgactctttgccgcgtttccgtaggaattgaagacgttgaagatctatgggaagacctcaacgcctcaatcgacaaagttctgggttagaactcgtagccagtaaccagaccttca

SEQ ID NO: 114 - protein, 382 aa, Corynebacterium glutamicum
MNFYPPSVPINPAWRPPTVTVQAGRPARTPGAPMNPPITLSSTYVHDSEKAYGRDGNDGWGAFEAAMGTLDGGFAVSYSSGLAAATSIADLVPTGGTVVLPKAAYYGVTNIFARMEARGRLKVRTVDADNTEEVIAAAQGADVVWVESIANPTMVVADIPAIVDGVRGLGVLTVVDATFATPLRQRPLELGADIVLYSATKLIGGHSDLLLGVAVCKSEHHAQFLATHRHDHGSVPGGLEAFLALRGLYSLAVRLDRAESNAAELSRRLNAHPSVTRVNYPGLPDDPQHEKAVRVLPSGCGNMLSFELDATPERTDEILESLSLLTHATSWGGVETAIERRTRRDAEVVAGVPMTLCRVSVGIEDVEDLWEDLNASIDKVLG

SEQ ID NO: 115 - DNA, 928 bp, Corynebacterium glutamicum
  CDS (101)..(898): RXA02536
aggtacatgctgctgattcaagtggtttttacgatgctgggcaagaagtgatcacgcgaacctgtgtataacttgcctcaaagcgcctaggctgtggattatgcgtattgccttgcttcagatctcgacgaattccgataagatggacaacttcgccctgctgcgtgatgctgctgaaaaagctgcggaacagggggctcgggtgttggtgtttccggaggcgacttcgcaaagctttggtacgggaaggcttgatactcaggcggaggagctcgatggcgaattctccaccgcggtacgaaaattagccgatgagctggacgttgtcatcgttgcgggcatgttcacccctgctgacaccgtgcagcgcggtgaaaaaacgatctcgcgcgtcaacaacaccgtgctgattagtggcgctggattgcatcagggatacaacaaaattcacacatatgacgcgttcggttatagggaatccgacactgtgaaaccgggcgatgagctggttgtattcgaggtcgacgatattaaatttggtgtggcgacatgctacgatattcgattcccagaacagttcaaagacctcgcccgcaacggtgcacagataattgtggttcccacgtcgtggcaagacggtcctggaaaattagaacaatgggaagtcctccctcgcgcgcgtgcactggattccacctgctggatcgtagcgtgtgggcaagcgcgacttccagaagaattacgcgatgaacgaaaaggccctacggggattggtcattccatggtgacaaacccacacggtgaagtaattgctagcgcgggttatgagccagaaatgttgatcgcggatattgatgtcagcggtttggccaaaattcgggaggcattgcctgttctttaaccactgtctaaggaatcactcgttggg

SEQ ID NO: 116 - protein, 266 aa, Corynebacterium glutamicum
MRIALLQISTNSDKMDNFALLRDAAEKAAEQGARVLVFPEATSQSFGTGRLDTQAEELDGEFSTAVRKLADELDVVIVAGMFTPADTVQRGEKTISRVNNTVLISGAGLHQGYNKIHTYDAFGYRESDTVKPGDELVVFEVDDIKFGVATCYDIRFPEQFKDLARNGAQIIVVPTSWQDGPGKLEQWEVLPRARALDSTCWIVACGQARLPEELRDERKGPTGIGHSMVTNPHGEVIASAGYEPEMLIADIDVSGLAKIREALPVL

SEQ ID NO: 117 - DNA, 997 bp, Corynebacterium glutamicum
  CDS (101)..(967): RXA02560
ttggggcaagccagctaacgcatttcttgtggaaaccgcagacattgaggccgcccacgcggaacttctaagagcagtggaatgaaataatccggtgctgatgcagggcaactcgcttaatctggcagacaacagcgagagaaagaagcccatgccgtcaccaggagaacttttagccgcccgctacggacaacctgcaacctggacgccaccgcagtggaatgagacgcttgatgtcattcaccagcatcgatcagttcgcaggtggttggataaaccggttgatgatgacaccatccgcaccattatttccgccgcacaatcggctggaacctcttccaataagcaggtcatttctgtcatcgtggttaaagatcctgagctgaggaaaggcctcgcggggatcactcgccagatgtttccgcaccttgagcaggttcccgcggtgctgatttggttgattgattattcccgaatcagtgcggtggcagccagagaagatctcccaacaggggctcttgattatctcgatgaggccgcgttggggttcctcgacgccggaatcgcagctcaaaacgctgcaattgctgcggagtcacttggattgggaacgctctatttgggttcggtgcgcaacgatgcggaagccgtgcacaaattgcttggccttccacctgagatcgtgcctgtcgtgggcttggaaattgggcatgcggatccgtctgaacctgccggaattaaacctcgcctgccacaagaagccattgttcactgggatacctacaccgagaaaaacctcgaacttatcgattcctacgaccgcgccctcgacacttactattctcgctacggccagcaccagctctggtcgaagcagacggcgcatagggcggcgtcgaaaagcttttcaaaaaccaacaggcagttccttaggggcgtgtttgagcgcgccgggtttgggctgagataaaagcatgattatggacgcctccctccc

SEQ ID NO: 118 - protein, 289 aa, Corynebacterium glutamicum
MQGNSLNLADNSERKKPMPSPGELLAARYGQPATWTPPQWNETLDVIHQHRSVRRWLDKPVDDDTIRTIISAAQSAGTSSNKQVISVIVVKDPELRKGLAGITRQMFPHLEQVPAVLIWLIDYSRISAVAAREDLPTGALDYLDEAALGFLDAGIAAQNAAIAAESLGLGTLYLGSVRNDAEAVHKLLGLPPEIVPVVGLEIGHADPSEPAGIKPRLPQEAIVHWDTYTEKNLELIDSYDRALDTYYSRYGQHQLWSKQTAHRAASKSFSKTNRQFLRGVFERAGFGLR

SEQ ID NO: 119 - DNA, 2128 bp, Corynebacterium glutamicum
  CDS (101)..(2098): RXA02653
agacagagtgttagtgcgtggggcagctctcactttcatcgacatcactcgagtatgctcaccggccgtattcattccaataacccgcacagggaaactaatgataccgaagcccgacgtgaccgacttatatttagaggacctcttaaatgagggttcggaaaagattcggtccgccaaggatctttccgaacttaggacagttctaaaagaggtttcctcccaaattcaggaacgagctgggaaaaaagatgaagaatggggaatgggggccacttggcgggagctgtaccccagcatcgtggaacgcgcttcctacgaagggcgtgacagcctaatcggatttgatcacttagcccgggaaatggaaagattagccttcggcccaccatccgaaagttttgaatacctccaagaactcgtaaaatccggagtggtagacatcactcacctgcatcgtggccgggaaccactgacagatttagttcgtgaacttgaaataactgtggtgatagacgctgttcttcccccgccgggagtagtgccaggcacattggtgcacaatttggtaaaagagggatatgccagaatgcgtcctgggactcgggggttagatgtagcggctgacggcaccgttcaagggcaacgacatttggctgcagtcggacggatgacggaagatgtggttttgggtaatgacacattgtcgcgatcattacatgacataatcccgaagtgggctcgtcgagttatccgcgacgcgagcacgtatcccgatagggtacatggtactccaccgcttccggcacggttggaaccctgggcggaaaagctcacttcagatccggccacatgccgccacctgattgaagaattcgggagtcctgtgaatgtactccattcaggttctatgcctcgtaatataaatgagttggttgacgccggcattcagatgggggtggatactcgaatattttttgcccgcaaagcgaataagggtcttaccttcgttgatgccgttaaagacaccggtcatggtgtagatgtagccagtgaacgagagttatctcaggtgcttaatcgtggagtcccaggagagcggatcattctatccgcagctatcaaaccggacagactattggcattagcgatcgaaaatggcgtgatcatctctgtggattcgcgtgatgaattagatcgcatttcggctttggttggtgaccgcgttgcacgagttgcgcctagagtagctccagatcctgcagtcttacctccaactagatttggtgagcgtgctgcagactggggtaatcggcttaccgaggtgatacccggcgtggatattgtgggtcttcacgttcacctccatggctatgctgcaaaagaccgtgctctggctctgcaggaatgttgccaactcgtcgattctctcagagaatgcgggcattccccacagtttattgaccttggaggaggggtgcctatgagctacattgaatctgaggaagattggatccgttatcaatccgctaaatctgcgacttcagccgggtatgccgaatcctttacgtggaaagacgatccgttatctaatacgtacccgttctatcagaccccagtgcgcggtaattggttgaaagacgtgctttctaagggggtagctcagatgctcattgaccggggattgcggttacacctagagcctggtcgaagtttactagatgggtgtggcgtcactcttgccgaagttgcttttgtgaaaacccgaagtgacgggttgcctctagtgggactggctatgaaccgaacgcagtgccggactacatccgatgattttctcattgatcccctgcatatcactgacggtgatgtaggcgaggaaatcgaagcatatctagtgggtgcctactgcatcgaagatgagctgattttacgccggcgaatccgcttcccgagaggagtcaaaccaggagatatcatcggaattcctaacaccgcaggatacttcatgcatatcttggaaagtgcatcgcaccaaatcccgttggcgaaaaatgtagtgtggccggaggggcagttagacgatatcgatgcggattaagacataaccattcgctaatctttcgac

SEQ ID NO: 120 - protein, 666 aa, Corynebacterium glutamicum
MIPKPDVTDLYLEDLLNEGSEKIRSAKDLSELRTVLKEVSSQIQERAGKKDEEWGMGATWRELYPSIVERASYEGRDSLIGFDHLAREMERLAFGPPSESFEYLQELVKSGVVDITHLHRGREPLTDLVRELEITVVIDAVLPPPGVVPGTLVHNLVKEGYARMRPGTRGLDVAADGTVQGQRHLAAVGRMTEDVVLGNDTLSRSLHDIIPKWARRVIRDASTYPDRVHGTPPLPARLEPWAEKLTSDPATCRHLIEEFGSPVNVLHSGSMPRNINELVDAGIQMGVDTRIFFARKANKGLTFVDAVKDTGHGVDVASERELSQVLNRGVPGERIILSAAIKPDRLLALAIENGVIISVDSRDELDRISALVGDRVARVAPRVAPDPAVLPPTRFGERAADWGNRLTEVIPGVDIVGLHVHLHGYAAKDRALALQECCQLVDSLRECGHSPQFIDLGGGVPMSYIESEEDWIRYQSAKSATSAGYAESFTWKDDPLSNTYPFYQTPVRGNWLKDVLSKGVAQMLIDRGLRLHLEPGRSLLDGCGVTLAEVAFVKTRSDGLPLVGLAMNRTQCRTTSDDFLIDPLHITDGDVGEEIEAYLVGAYCIEDELILRRRIRFPRGVKPGDIIGIPNTAGYFMHILESASHQIPLAKNVVWPEGQLDDIDAD

SEQ ID NO: 121 - DNA, 1468 bp, Corynebacterium glutamicum
  CDS (101)..(1438): RXA02754
attatgaagccatcggagttggtgtggcctacaagggtgatcatgcgtggatagtggtggagttcactgtagctcccgctgattccgtagaatcaacagagtgaataccaatccgtctgaattctcctcaaaccgttcaacagctctccttactgataaatatgagctgaccatgcttcaagcagcgctcgctgatggttctgcagaacgcccctcaacgtttgaggtctttagccgccgcctccccaacgagcgccgatacggtgtcgtcgcaggaacagcacgagtgctgaaggcgattcgtgactttgtattcacagaggaacaactcgccgatcttgactttttagacgaccgtaccctggaatacctccgcaactaccgattcaccggccaagttgatggctaccgcgaaggcgaaatctacttcccgcagtcccctcttctgactgtgcgtggcacgtttgcagaatgcgtcatcctagaaactgtcattttgtccatcatgaatgcagattctgccgtcgcttccgccgctgcgcgcatggtcaccgcagctgatggtcgccccatcatcgaaatgggatccaggcgcacccacgaatactcggcagtcaccgcatcccgcgcagcatacctcgctggattctccaccacctccaacctcgaggcggcctaccgctacggaattccagcatccggaacctccgcccacgcatggactttgctgcacatcaacgatgacggcacccccaacgaagcagcagctttcaaagcacaggttgaatccctcggcgtggacaccaccttgctggtagatacttatgacatcacccaaggtgtggccaccgccattgaagttgcaggtccagaccttggtggcgtacgtatcgactccggcgacctaggtgtgcttgcccgaaaggtccgcaagcagctcgacgatctcaacgcccacaacaccaagattgtggtctcctccgacctggatgaattcgccatcgcgggtcttcgcggcgaaccagttgacgtctttggcgttggcacctccgttgtcacaggttctggcgcaccaaccgctggcctcgtgtacaagatcgtggaagttgccggtcaccctgtggccaagcgttcccgaaacaaggaaagctacggtggtggcaagaaggctgtgcgcacccaccgcaagtccggtaccgcaatcgaagaaatcgtctacccattcaatgccgaagcaccagatactggaaagctcgacactttgagcctgaccatcccattgatgcgcgacggtgaaatcgttccaggtttgcctactttggaagattcccgagcgtatttggccaagcaattggtctctttaccatgggaaggccttgcactgtctcgcgatgagcctgttttgcacactcgtttcgtgggtttcccgccggccgcttagacaattcggtctcaccaaaccacagtg

SEQ ID NO: 122 - protein, 446 aa, Corynebacterium glutamicum
VNTNPSEFSSNRSTALLTDKYELTMLQAALADGSAERPSTFEVFSRRLPNERRYGVVAGTARVLKAIRDFVFTEEQLADLDFLDDRTLEYLRNYRFTGQVDGYREGEIYFPQSPLLTVRGTFAECVILETVILSIMNADSAVASAAARMVTAADGRPIIEMGSRRTHEYSAVTASRAAYLAGFSTTSNLEAAYRYGIPASGTSAHAWTLLHINDDGTPNEAAAFKAQVESLGVDTTLLVDTYDITQGVATAIEVAGPDLGGVRIDSGDLGVLARKVRKQLDDLNAHNTKIVVSSDLDEFAIAGLRGEPVDVFGVGTSVVTGSGAPTAGLVYKIVEVAGHPVAKRSRNKESYGGGKKAVRTHRKSGTAIEEIVYPFNAEAPDTGKLDTLSLTIPLMRDGEIVPGLPTLEDSRAYLAKQLVSLPWEGLALSRDEPVLHTRFVGFPPAA

SEQ ID NO: 123 - DNA, 1468 bp, Corynebacterium glutamicum
  CDS (101)..(1438): RXA02758
ggctggtgcttttcatattccgacttggggcacccctgaatacatctcacccaattccccataactagacaattgcccagcaacgactgataagtctccaatgtcgtgttccgcgctcagacatgagacaattgttgccgtgactgaactcatccagaatgaatcccaagaaatcgctgagctggaagccggccagcaggttgcattgcgtgaaggttatcttcctgcggtgatcacagtgagcggtaaagaccgcccaggtgtgactgccgcgttctttagggtcttgtccgctaatcaggttcaggtcttggacgttgagcagtcaatgttccgtggctttttgaacttggcggcgtttgtgggtatcgcacctgagcgtgtcgagaccgtcaccacaggcctgactgacaccctcaaggtgcatggacagtccgtggtggtggagctgcaggaaactgtgcagtcgtcccgtcctcgttcttcccatgttgttgtggtgttgggtgatccggttgatgcgttggatatttcccgcattggtcagaccctggcggattacgatgccaacattgacaccattcgtggtatttcggattaccctgtgaccggcctggagctgaaggtgactgtgccggatgtcagccctggtggtggtgaagcgatgcgtaaggcgcttgctgctcttacctctgagctgaatgtggatattgcgattgagcgttctggtttgctgcgtcgttctaagcgtctggtgtgcttcgattgtgattccacgttgatcactggtgaggtcattgagatgctggcggctcacgcgggcaaggaagctgaagttgcggcagttactgagcgtgcgatgcgcggtgagctcgatttcgaggagtctctgcgtgagcgtgtgaaggcgttggctggtttggatgcgtcggtgatcgatgaggtcgctgccgctattgagctgacccctggtgcgcgcaccacgatccgtacgctgaaccgcatgggttaccagaccgctgttgtttccggtggtttcatccaggtgttggaaggtttggctgaggagttggagttggattatgtccgcgccaacactttggaaatcgttgatggcaagctgaccggcaacgtcaccggaaagatcgttgaccgcgctgcgaaggctgagttcctccgtgagttcgctgcggattctggcctgaagatgtaccagactgtcgctgtcggtgatggcgctaatgacatcgatatgctctccgctgcgggtctgggtgttgctttcaacgcgaagcctgcgctgaaggagattgcggatacttccgtgaaccacccattcctcgacgaggttttgcacatcatgggcatttcccgcgacgagatcgatctggcggatcaggaagacggcactttccaccgcgttccattgaccaatgcctaaagattcgcttctcgacgcccacctcct

SEQ ID NO: 124 - protein, 446 aa, Corynebacterium glutamicum
MSCSALRHETIVAVTELIQNESQEIAELEAGQQVALREGYLPAVITVSGKDRPGVTAAFFRVLSANQVQVLDVEQSMFRGFLNLAAFVGIAPERVETVTTGLTDTLKVHGQSVVVELQETVQSSRPRSSHVVVVLGDPVDALDISRIGQTLADYDANIDTIRGISDYPVTGLELKVTVPDVSPGGGEAMRKALAALTSELNVDIAIERSGLLRRSKRLVCFDCDSTLITGEVIEMLAAHAGKEAEVAAVTERAMRGELDFEESLRERVKALAGLDASVIDEVAAAIELTPGARTTIRTLNRMGYQTAVVSGGFIQVLEGLAEELELDYVRANTLEIVDGKLTGNVTGKIVDRAAKAEFLREFAADSGLKMYQTVAVGDGANDIDMLSAAGLGVAFNAKPALKEIADTSVNHPFLDEVLHIMGISRDEIDLADQEDGTFHRVPLTNA

SEQ ID NO: 125 - DNA, 1297 bp, Corynebacterium glutamicum
  CDS (101)..(1267): RXA02790
cagtagaaatccttcaaacctggttggatgctcgcacccgagcccttgaaccacaatccacagacacccaagatttcgacgagaagggaaatttcccaggatgaaccaaatccgaaaccgccggatggagcccgtctacgtaaagcgccgccaacggtttattgccgtgacgatcgcttcactcatcctcattatcggtgccatcatctatatcggtgtagccacctcaaaccggacgccacatgactatgaaggctccggaaacggtgtggttcagctggtcgaaatccctgaaggttcctccatatcagagctcggcccagagttggaagaacgagatatcgtggccaccaactcagcgttccaaacagcggccagcaacaaccccaacgcgggtagtgtacagccaggtttctaccgtctgcaggaacaaatgaacgcagcagctgcagtgtcggctctgcttgatccagacaaccaggttgatctcctcgacattcacggcggcgccaccttgatggacgtcactgttgtcggcggaaacacccgcgcgggaatctactcccagatcgcagccgtgacctgcaccgaaggctccgccaactgcatcaccgctgaggatttgcagcaggttgcctccaccgtgtcgcctgcagaattgggtgtcccagattgggcaatcgctgctgtggaagctcgcggaactgatccaaagcgcctcgaaggcctgatcatgcctggccaatacgtggtggatccatccaacgacgcccagggaatcctcaccgatctgatcacgcgatcagcaaaccatttccaagaaaccgacatcacgggccgtgcagatgccatcggacttactccatatgagctggtcaccgcagcatctttaatcgagcgcgaagcaccagcaggagattttgataaggtcgcccgcgtcatcttgaaccgtctcgccgagccaatgcagctgcaattcgactccaccgtcaactacggtctgtctgaacaagaagtagcaaccaccgacgaagaccgtcagaccgtcaccccatggaacacttacgccatggacggcctgccacaaacccccatcgccgcagtatccaccgaagcactccaagccatggaaaaccctgcagaaggaaactggctgtactttgtcaccatcgacaccgatggaaccaccgtgttcaacgacaccttcgaagagcacgaagccgacattgagcaagctttgaacagtggcgttctagacagcaaccgataaggatcagcgaataaaattgggttctca

SEQ ID NO: 126 - protein, 389 aa, Corynebacterium glutamicum
MNQIRNRRMEPVYVKRRQRFIAVTIASLILIIGAIIYIGVATSNRTPHDYEGSGNGVVQLVEIPEGSSISELGPELEERDIVATNSAFQTAASNNPNAGSVQPGFYRLQEQMNAAAAVSALLDPDNQVDLLDIHGGATLMDVTVVGGNTRAGIYSQIAAVTCTEGSANCITAEDLQQVASTVSPAELGVPDWAIAAVEARGTDPKRLEGLIMPGQYVVDPSNDAQGILTDLITRSANHFQETDITGRADAIGLTPYELVTAASLIEREAPAGDFDKVARVILNRLAEPMQLQFDSTVNYGLSEQEVATTDEDRQTVTPWNTYAMDGLPQTPIAAVSTEALQAMENPAEGNWLYFVTIDTDGTTVFNDTFEEHEADIEQALNSGVLDSNR

SEQ ID NO: 127 - DNA, 883 bp, Corynebacterium glutamicum
  CDS (101)..(853): RXA02912
catcggtgtcggttcactgatggtggccaagaaggttggataacagggttaatcttgggtgatattgaaatgacgtattcctgattgggctgaaaaatctgtgacatcacctgaattacaaaacatccttaacaattattggagcggcagggcagaggcttaccacctcaaccaaacccaaagcgagcgtgcacaatttgaacgccccatctgggaaaaggtgtggtcgaaggctttgcctatcgtgtcggaagaagcggtaaaggttctcgatcttggctgtggcgctggttatgtcacccaccttctaagcgattgcggatacgaaacaatcggcgttgatggttctgaggaaatgatcaatcaagctacgcaggagaatggtcttcgcaggtcgacgggtcgggcgactgccatttttcaggtcggggatgcgcatgatcccgagttccgggaaggctcttttgatgcgataaccagccggtatgtgttgtggactctgctggatccccaggcagcgattaatcgttgggtgtctttgctaaaacctggtggggttattgcgtgcgtagatgcggcttggtatccgaagggcattgatgctggcacggaagtagattcagtggatggtccgagtgctttcgtagagacctataccccggaacttttgaggaatcttcccatgtcaacgacctccactggccacaatttcgcagagcttttccacaacgctggcctcaaagaagtcacattgacacccattgaggggctggctgaacttgaccagcgatttggcctctcaccagggcatgagtcgactccgcagttcctattcaggggaattaaatccagttagtgctgttttaagcggtcgagaatctgg

SEQ ID NO: 128 - protein, 251 aa, Corynebacterium glutamicum
VTSPELQNILNNYWSGRAEAYHLNQTQSERAQFERPIWEKVWSKALPIVSEEAVKVLDLGCGAGYVTHLLSDCGYETIGVDGSEEMINQATQENGLRRSTGRATAIFQVGDAHDPEFREGSFDAITSRYVLWTLLDPQAAINRWVSLLKPGGVIACVDAAWYPKGIDAGTEVDSVDGPSAFVETYTPELLRNLPMSTTSTGHNFAELFHNAGLKEVTLTPIEGLAELDQRFGLSPGHESTPQFLFRGIKSS

SEQ ID NO: 129 - DNA, 1498 bp, Corynebacterium glutamicum
  CDS (101)..(1468): RXA02970
aaccgacaaaacagccgttcacgtgctaaagcagctcggcttgatctagggtgaggtgagttatttaaagacttcataatattttggggagtgaactggtttggcattgaagggttacaccaactttgacggtgaattcatcgaattcggatctgtgcaagcaaaagaagaggaaaaacgggcattcgacaacgatcgcgcgcacgttttccactcctggtccgcgcaggacaaaatcagccccaaagtatgggcagctgccgaaggttccacgctgtacgacttcgacggcaacgccttcatcgacatgggttcccaacttgtctcggcaaacttaggccacaacaaccctcgattagttgaggcgatccagcgccaagcagcccggttgaccaacatcaacccggccttcggcaatgatgtgcgctctgatgttgctgcaaagatcgtgtcgatggcccgtggcgaattctcccacgtgtttttcaccaacggcggcgccgacgccatcgagcactccatccgcatggctcgcctgcacaccggacgcaacaaaattctgtccgcataccgcagctaccacggcgcaaccggatccgcgatgatgctcaccggcgaacaccgccgcctgggcaaccccaccaccgacccagatatctaccacttctgggcaccattcctgcaccactcctcattctttgccaccacccaagaagaagaatgcgaacgcgcactcaagcacttggaagatgtcatcgcgtttgaaggtgctggcatgatcgcagcgatcgtcctggagccagtggtgggatcatcaggaatcatcctgccaccagcaggttacttaaatggcgtgcgcgaactttgcaacaagcacggcatcctcttcatcgccgacgaagtcatggtcggattcggacgcaccggaaaactgtttgcttacgagcatgctggcgacgatttccagccagacatgatcaccttcgccaagggtgttaacgcaggttacgccccactcggtggcatcgtgatgacccaatcaatccgcgataccttcggatcagaggcatactccggcggactcacctactccggacacccacttgcagtagcacccgccaaggcagcgctggagatttacgcggaaggagagatcattccacgcgtagctcgacttggcgctgaactgatcgaacctcgccttcgtgaactagcggaagaaaacgtagcgatcgctgacgtgcggggcatcggattcttctgggcagtggagttcaatgcagacgccactgccatggctgccggtgctgcagaattcaaggaacgcggcgtgtggccgatgatctccggcaaccgattccacatcgcgccgccgctgaccaccactgatgacgaattggtagcactgctggacgcggtggaagctgcagcccaagctgtcgagctgaccttcgctggggcgttgttctaagttttctagataacaaggccagcacag

SEQ ID NO: 130 - protein, 456 aa, Corynebacterium glutamicum
LALKGYTNFDGEFIEFGSVQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 131 - DNA, 1231 bp, Corynebacterium glutamicum
  CDS (101)..(1201): RXA03003
tcgatgatctgggctccccaggtggtgcggctaagcttggaccacaagattttgatcacccaatgatcgctgcgctgccgcctcaggcataatctaacgcatgacctctcgcaccccgcttgtttctgttcttcctgattttccgtgggattcgctcgcttccgcaaaagccaaagctgcgtctcacccggatgggatcgtgaatctttctgttggcactccggttgatccggtcgcgcccagcattcagatcgcgttggcagaagcagcggggttttcgggttaccctcaaaccatcggcaccccggaactccgcgcagccatcaggggcgcgcttgagcggcgctacaacatgacaaagcttgtcgacgcctccctcctccccgtcgtgggtaccaaggaggcaattgcccttcttccattcgcgttgggtatttccggcaccgttgtcatcccagagattgcgtacccaacctacgaagtcgctgtcgtggccgcaggatgcaccgtgttgcgttctgattcgctgtttaagctcggcccgcagatcccgtcgatgatgtttatcaactcaccatccaaccccacaggcaaggttctgggcatcccacacttgcgcaaggttgtgaagtgggcgcaggaaaacaacgtgatcctcgcagctgatgaatgctacttgggtcttggctgggacgatgaaaacccaccgatctcaattttggatccacgtgtctgcgatggcgaccacaccaacttgatcgccattcactcgctgtctaaaacctcaaacctcgcttcttaccgcgcaggttacctcgttggcgatccagcgctgattggtgaactcacggaagtccgtaagaacttgggtctcatggttcctttcccaatccagcaggccatgatcgcagccctcaacgacgatgaccaagaggcagggcagaagctcacctacgcgattcgtcgagcaaaactcatgcgcgccctgttggaatccggctttcaggtagataattctgaagcgggtctgtacctctgggcgacgcgtgaagaaccttgccgtgacactgtcgattggttcgctgagcgtggcattctcgttgccccaggagacttctatggccctcgcggagcgcagcatgtgcgtgtggcgatgaccgaaaccgacgagcgcgtcgacgcctttgtttctcgcctgagctaaacacgactaagctttatttgtttaatt

SEQ ID NO: 132 - protein, 367 aa, Corynebacterium glutamicum
MTSRTPLVSVLPDFPWDSLASAKAKAASHPDGIVNLSVGTPVDPVAPSIQIALAEAAGFSGYPQTIGTPELRAAIRGALERRYNMTKLVDASLLPVVGTKEAIALLPFALGISGTVVIPEIAYPTYEVAVVAAGCTVLRSDSLFKLGPQIPSMMFINSPSNPTGKVLGIPHLRKVVKWAQENNVILAADECYLGLGWDDENPPISILDPRVCDGDHTNLIAIHSLSKTSNLASYRAGYLVGDPALIGELTEVRKNLGLMVPFPIQQAMIAALNDDDQEAGQKLTYAIRRAKLMRALLESGFQVDNSEAGLYLWATREEPCRDTVDWFAERGILVAPGDFYGPRGAQHVRVAMTETDERVDAFVSRLS

SEQ ID NO: 133 - DNA, 763 bp, Corynebacterium glutamicum
  CDS (101)..(733): RXA03171
atactttgttggactggaaaagtggccgtttggttccctccaagcccaaattcgcccgcgcggtcttcttctgggcggcaatgatttaacatgtgaagctatggacatcaccatcgtcaaccacccactcgttgctagccgcctaaccctgttgcgcgacgagcgcagcgacaacgcagctttccgtgcagcagccaacgacctcggcgccatgctgatctacgaagcatcccgagatctggaagtcgaacacttcgacaccaaaacccccgttgccatggctgaaggtactcgcctgaagcagccacccatcatcgttcccatcatccgtgcaggtctcggcatgatcgacccagcgctgtcgatgattccggatgcacaggtcggcttcattggccttgcccgcgatgaggaaacccatgagccagtcccataccttgaggcgctgccacaggatctaagcaaccagcctgtattccttgtcgatcccatgctggccaccggcggttccctcctgcacgcgatccgccttcttgctgatcgtggcgccaccgacatcaccgccatctgcatggtttctgcgcagccaggtgtggacgcattggcggaatctggtcttccagttcgtttggttaccgccaccatcgacccaggtctagacgaaaacgcctacatcgtgcctggtcttggagatgccggtgatcgtctctacggtccgcgaaacatcgacctttaaaagtttctaagggcattacggaaaatt

SEQ ID NO: 134 - protein, 211 aa, Corynebacterium glutamicum
MDITIVNHPLVASRLTLLRDERSDNAAFRAAANDLGAMLIYEASRDLEVEHFDTKTPVAMAEGTRLKQPPIIVPIIRAGLGMIDPALSMIPDAQVGFIGLARDEETHEPVPYLEALPQDLSNQPVFLVDPMLATGGSLLHAIRLLADRGATDITAICMVSAQPGVDALAESGLPVRLVTATIDPGLDENAYIVPGLGDAGDRLYGPRNIDL

SEQ ID NO: 135 - DNA, 1288 bp, Corynebacterium glutamicum
  CDS (101)..(1258): RXA03282
aggggctagttttacacaaaagtggacagcttggtctatcattgccagaagaccggtccttttagggccatagaattctgattacaggagttgatctaccttgtcttttgacccaaacacccagggtttctccactgcatcgattcacgctgggtatgagccagacgactactacggttcgattaacaccccaatctatgcctccaccaccttcgcgcagaacgctccaaacgaactgcgcaaaggctacgagtacacccgtgtgggcaaccccaccatcgtggcattagagcagaccgtcgcagcactcgaaggcgcaaagtatggccgcgcattctcctccggcatggctgcaaccgacatcctgttccgcatcatcctcaagccgggcgatcacatcgtcctcggcaacgatgcttacggcggaacctaccgcctgatcgacaccgtattcaccgcatggggcgtcgaatacaccgttgttgatacctccgtcgtggaagaggtcaaggcagcgatcaaggacaacaccaagctgatctgggtggaaaccccaaccaacccagcacttggcatcaccgacatcgaagcagtagcaaagctcaccgaaggcaccaacgccaagctggttgttgacaacaccttcgcatccccatacctgcagcagccactaaaactcggcgcacacgcagtcctgcactccaccaccaagtacatcggaggacactccgacgttgttggcggccttgtggttaccaacgaccaggaaatggacgaagaactgctgttcatgcagggcggcatcggaccgatcccatcagttttcgatgcatacctgaccgcccgtggcctcaagacccttgcagtgcgcatggatcgccactgcgacaacgcagaaaagatcgcggaattcctggactcccgcccagaggtctccaccgtgctctacccaggtctgaagaaccacccaggccacgaagtcgcagcgaagcagatgaagcgcttcggcggcatgatctccgtccgtttcgcaggcggcgaagaagcagctaagaagttctgtacctccaccaaactgatctgtctggccgagtccctcggtggcgtggaatccctcctggagcacccagcaaccatgacccaccagtcagctgccggctctcagctcgaggttccccgcgacctcgtgcgcatctccattggtattgaagacattgaagacctgctcgcagatgtcgagcaggccctcaataacctttagaaactatttggcggcaagcagcttttc

SEQ ID NO: 136 - protein, 386 aa, Corynebacterium glutamicum
LSFDPNTQGFSTASIHAGYEPDDYYGSINTPIYASTTFAQNAPNELRKGYEYTRVGNPTIVALEQTVAALEGAKYGRAFSSGMAATDILFRIILKPGDHIVLGNDAYGGTYRLIDTVFTAWGVEYTVVDTSVVEEVKAAIKDNTKLIWVETPTNPALGITDIEAVAKLTEGTNAKLVVDNTFASPYLQQPLKLGAHAVLHSTTKYIGGHSDVVGGLVVTNDQEMDEELLFMQGGIGPIPSVFDAYLTARGLKTLAVRMDRHCDNAEKIAEFLDSRPEVSTVLYPGLKNHPGHEVAAKQMKRFGGMISVRFAGGEEAAKKFCTSTKLICLAESLGGVESLLEHPATMTHQSAAGSQLEVPRDLVRISIGIEDIEDLLADVEQALNNL

SEQ ID NO: 137 - DNA, 1336 bp, Corynebacterium glutamicum
  CDS (101)..(1306): RXA03465
gatgaggtggataaaacctccgtcggtaaatatgacaagaaggacctccgcaaccacctgcgcaacggcgatttcgaagtaattaagcttaaagggccaggtgaaaaataacttccctatttattccggcttttactggctttattccgcagctctttctaggatgggcaagaagatgactactcgcctttatctttcgccaacgccgccccgaaatgatcgggagggggcgtcgaaaagcacttctgcgagcatcaaacatgatgcgtacctgccacccgcagacggcaatcgcgtgcttgtggacagattcggacgcatcgcgcgtgacctgcgggtgtcactgaccgaccgatgcaacctccgctgcacctattgcatgcccgcggagggtttagagtggctgcccaccgagcagacgcttaacgacgccgaggtgctgcgactcatccgcattgcggtggttaagctgggcattcgtcaaattcgattcaccggcggcgagcctttactgcggaaaaatttggaagacatcatcgccggcaccgcagccctgcgcaccgacgaaggcgaaaaagttcacatcgctctcaccaccaacggccttggcctagacaaacgcatcgcaggactgaaagaagctggtcttgaccgggtcaatatttcactcgacaccatcgacgccgaacgctacgtctcgctaaccaggcgtgatcgattgtccggtgtgttggcgtccatcgatgccgctgttgccgctggccttcacccagtgaagatcaacgccgtggtcatgcctggggtcaatgaagtagatatcgtcccccttgcggaatactgcatttccaaaggctcccaactgcgattcatcgaacaaatgccacttggcccgcgcgagcagtggaaacgcggcgatatggtcacagccgaagaaatcctggcgcgcctggaagaaaaattcaccttatcccccgccaaggaaccccgaggagctgcacctgctgcgctgtggaatgtggtagataaatccaaccctgatatcactggacaaatcggcatcatcgcctcggtgacgcacccattttgcggagattgcgatcgctcccgcctcaccaccgacggcaccatccgaaactgccttttctcccgcactgaaactcccctacgtgacgcgcttcgcgacggcgcctccgacgatgagctcgcgcaactgtgggcaggcgccatgtgggagaagaaacccggccatggcatcgacgatgaaggcttcctccaaccagatcgccccatgtctgccatcggtggctagcccataccagccccaaccagacaggcg

SEQ ID NO: 138 - protein, 402 aa, Corynebacterium glutamicum
VKNNFPIYSGFYWLYSAALSRMGKKMTTRLYLSPTPPRNDREGASKSTSASIKHDAYLPPADGNRVLVDRFGRIARDLRVSLTDRCNLRCTYCMPAEGLEWLPTEQTLNDAEVLRLIRIAVVKLGIRQIRFTGGEPLLRKNLEDIIAGTAALRTDEGEKVHIALTTNGLGLDKRIAGLKEAGLDRVNISLDTIDAERYVSLTRRDRLSGVLASIDAAVAAGLHPVKINAVVMPGVNEVDIVPLAEYCISKGSQLRFIEQMPLGPREQWKRGDMVTAEEILARLEEKFTLSPAKEPRGAAPAALWNVVDKSNPDITGQIGIIASVTHPFCGDCDRSRLTTDGTIRNCLFSRTETPLRDALRDGASDDELAQLWAGAMWEKKPGHGIDDEGFLQPDRPMSAIGG

SEQ ID NO: 139 - DNA, 1402 bp, Corynebacterium glutamicum
  CDS (101)..(1372): RXA03677
atttttgaccctccgggggtgatttaacctaaaattccacacaaacgtgttcgaggtcattagattgataagcatctgttgttaagaaaggtgacttcctatgtcctcgatttcccgcaagaccggcgcgtcacttgcagccaccacactgttggcagcgatcgcactggccggttgtagttcagactcaagctccgactccacagattccaccgctagcgaaggcgcagacagccgcggccccatcacctttgcgatgggcaaaaacgacaccgacaaagtcattccgatcatcgaccgctggaacgaagcccaccccgatgagcaggtaacgctcaacgaactcgccggtgaagccgacgcgcagcgcgaaaccctcgtgcaatccctgcaggccggcaactctgactacgacgtcatggcgctcgacgtcatctggaccgcagacttcgcggcaaaccaatggctcgcaccacttgaaggcgacctcgaggtagacacctccggactgctgcaatccaccgtggattccgcaacctacaacggcaccctctacgcactgccacagaacaccaacggccagctactgttccgcaacaccgaaatcatcccagaagcaccagcaaactgggctgacctcgtggaatcctgcacgcttgctgaagaagcaggcgttgattgcctgaccactcagctcaagcagtacgaaggcctttcagtgaacaccatcggcttcatcgaaggttggggaggcagcgtcctagacgatgacggcaacgtcaccgtagacagcgacgacgccaaggcaggccttcaagcgcttgtcgacggcttcgacgacggcaccatctccaaggcatcccttgcagcgaccgaagaagaaaccaacctcgcattcaccgaaggccaaaccgcctacgccattaactggccatacatgtacaccaactccgaagaagccgaagcaaccgcaggcaaattcgaagtacagcccctcgtaggtaaagacggcgtcggcgtatccacccttggtggctacaacaacggcatcaacgtcaactccgaaaacaaggcaaccgcccgcgacttcatcgaattcatcatcaacgaagagaaccaaacctggttcgcggacaactccttcccaccagttctggcatccatctacgatgatgagtcccttgttgagcagtacccatacctgccagcactgaaggaatccctggaaaacgcagcaccacgcccagtgtctcctttctacccagccatctccaaggcaatccaggacaacgcctacgcagcgcttaacggcaacgtcgacgttgaccaggcaaccaccgatatgaaggcagcgatcgaaaacgcttccagctagttcggtaatttagttcattctccggcc

SEQ ID NO: 140 - protein, 424 aa, Corynebacterium glutamicum
MSSISRKTGASLAATTLLAAIALAGCSSDSSSDSTDSTASEGADSRGPITFAMGKNDTDKVIPIIDRWNEAHPDEQVTLNELAGEADAQRETLVQSLQAGNSDYDVMALDVIWTADFAANQWLAPLEGDLEVDTSGLLQSTVDSATYNGTLYALPQNTNGQLLFRNTEIIPEAPANWADLVESCTLAEEAGVDCLTTQLKQYEGLSVNTIGFIEGWGGSVLDDDGNVTVDSDDAKAGLQALVDGFDDGTISKASLAATEEETNLAFTEGQTAYAINWPYMYTNSEEAEATAGKFEVQPLVGKDGVGVSTLGGYNNGINVNSENKATARDFIEFIINEENQTWFADNSFPPVLASIYDDESLVEQYPYLPALKESLENAAPRPVSPFYPAISKAIQDNAYAALNGNVDVDQATTDMKAAIENASS

SEQ ID NO: 141 - DNA, 901 bp, Corynebacterium glutamicum
  CDS (101)..(871): RXA03695
atagctacatacaatggaaaattacgtatgatgcgtctcacgctaacctgataagaaaggaaaaataagggacaatccccgcagagggggtagccaagcggtgtcaggagcagtgcccgagacgccgtaccatcaacgatggctcgctttccccgatgctgtgtcgtcctacaggccgttagaatccagactcgcgggcactagccgcgcgactgccgacaaccgcacgccgtgtaccggaaggcttggaacgcctagggtgttcctcatggcaacagatgacgttagcaaggcctacagctcaccgacctttgatgcggaggcactgctcggaacggtaatctcggccgaggaccccgaccgcgtgctcatcgagccctgggcgaccggcgtcgacggggtgatcctcgatgtgggctctggtaccgggcggtggaccggtcacctcgcgagcctcggacaccagatcgagggactggaaccagcgacacggctcgtagagctcgctcgtcagacacatccctcagtgacctttcaccacggcactattaccgacctctcagactcgccgaagcgctgggcaggcctgttggcctggtactccctgatccacatgggcccgggcgagctgcccgacgccctggtcgcactgcggatggcggtggaggatggtggtggcctgctgatgtcctttttctccgggccttctctggaaccgatgtatcatcccgtggccaccgcctaccggtggccactgcccgagcttgcccaggcactggagaccgcgggtttccaggtcaccagtagtcactgggatcctcggttcccccatgcctatctcaccgccgaggccagcaagcagaatctcgcctgacagtggtggcctactcggtagtcgtct

SEQ ID NO: 142 - protein, 257 aa, Corynebacterium glutamicum
VSGAVPETPYHQRWLAFPDAVSSYRPLESRLAGTSRATADNRTPCTGRLGTPRVFLMATDDVSKAYSSPTFDAEALLGTVISAEDPDRVLIEPWATGVDGVILDVGSGTGRWTGHLASLGHQIEGLEPATRLVELARQTHPSVTFHHGTITDLSDSPKRWAGLLAWYSLIHMGPGELPDALVALRMAVEDGGGLLMSFFSGPSLEPMYHPVATAYRWPLPELAQALETAGFQVTSSHWDPRFPHAYLTAEASKQNLA

SEQ ID NO: 143 - DNA, 1582 bp, Corynebacterium glutamicum
  CDS (101)..(1552): RXA03754
tttgggcgggaggtgacatttatgcctcttaatagctatactgtcccatgaaacgatattttaatctcatatagtgagatttacagatttttaaaggacggtgagttccatgaccagccccgtggagaacagcacctcaactgagaagctgaccctggcagagaaggtgtggcgcgaccatgtcgtgtccaagggagaaaacggcgagcccgacctcctctacatcgacctgcagctgctgcatgaagtgacctcaccacaggcatttgacggcctgcgcatgaccggccgtaaactgcgccacccagaactgcacctggccaccgaagaccacaacgtgccaaccgaaggcatcaagactggctcactgctggaaatcaacgacaagatttcccgcctgcaggtatctactctgcgcgacaactgtgaagaattcggcgtgcgcctgcacccaatgggtgatgtccgacagggcatcgtgcacaccgtcggcccacagctcggcgcaacccagccaggcatgaccattgtgtgcggtgactcccacacctccacccacggtgcttttggctccatggcattcggcatcggtacctcagaggttgagcacgtcatggctactcaaaccctgccactgaagcctttcaagaccatggccattgaagttactggtgaactgcagccaggtgtttcctccaaggacctgattctggcgattatcgccaagatcggcaccggcggcggacagggctacgttctggaataccgcggcgaagcaatccgtaagatgtccatggatgcacgcatgaccatgtgcaacatgtccatcgaagctggcgcacgtgccggcatgatcgccccagaccaaaccaccttcgactacgttgaaggccgcgaaatggcaccaaagggcgccgactgggacgaagcagttgcttactggaagaccctgccaaccgacgaaggcgcaacctttgacaaggtcgtagaaatcgatggctcggcactgaccccattcatcacctggggcaccaacccaggccagggcctgccactgggcgaatccgtaccaagcccagaagacttcaccaacgacaacgacaaggcagcagccgaaaaggcactgcagtacatggacctggtaccaggaaccccactgcgcgacatcaagatcgacaccgtcttcctgggatcctgcaccaacgcccgcatcgaagacctgcagatcgccgctgacatcctcaagggccacaaaatcgccgacggcatgcgcatgatggtcgtgccttcctccacctggatcaagcaagaggcagaagcgctcggactggacaaaatcttcaccgacgctggcgctgaatggcgtaccgcaggctgctccatgtgcctgggcatgaacccagaccaactgaagccaggcgagcgctccgcatccacctccaaccgaaacttcgaaggacgccaaggaccaggaggccgcacccacctggtatccccagcagtcgcagccgccaccgcaatccgcggcaccctgtcctcacctgcagatatctaaggaaggctagaaaacaatggaaaaatt

SEQ ID NO: 144 - protein, 484 aa, Corynebacterium glutamicum
VSSMTSPVENSTSTEKLTLAEKVWRDHVVSKGENGEPDLLYIDLQLLHEVTSPQAFDGLRMTGRKLRHPELHLATEDHNVPTEGIKTGSLLEINDKISRLQVSTLRDNCEEFGVRLHPMGDVRQGIVHTVGPQLGATQPGMTIVCGDSHTSTHGAFGSMAFGIGTSEVEHVMATQTLPLKPFKTMAIEVTGELQPGVSSKDLILAIIAKIGTGGGQGYVLEYRGEAIRKMSMDARMTMCNMSIEAGARAGMIAPDQTTFDYVEGREMAPKGADWDEAVAYWKTLPTDEGATFDKVVEIDGSALTPFITWGTNPGQGLPLGESVPSPEDFTNDNDKAAAEKALQYMDLVPGTPLRDIKIDTVFLGSCTNARIEDLQIAADILKGHKIADGMRMMVVPSSTWIKQEAEALGLDKIFTDAGAEWRTAGCSMCLGMNPDQLKPGERSASTSNRNFEGRQGPGGRTHLVSPAVAAATAIRGTLSSPADI

SEQ ID NO: 145 - DNA, 709 bp, Corynebacterium glutamicum
  CDS (101)..(679): RXA03829
cgaccttgtcctagctctacgcaatgcccaaaatcccctccctcttgcaggtcgtggcacacgcgaagcacagcaaagcatcctggaattagcagatcttttggcagctgatgtagccaccagcgcgcccgcccgaggattcttccatccctcaggaaactctcgcgacctggtcgtatgtggaggtttcgctgcgaccggtgcagcttcagaaatacgccgagccaacgtggcgcttgtgctgggcgccggtttgaaccaattcaccatggcattcggggaggctttcggtgaactcgcggaagtgctccaagtggatcttgaaacacagaccaccaacccgcgcattaaccatttcattagcgcagataacacaactgttgtagccgcagtgcttttaaagcttcgtacacaaaatttccacgcaccgcgccggctatacctggacgataatcctctgacatgccctggcggcgacgcccttgcagccgacggccgactcgatccacacagcctcatgcgccaacttaacggtattttgccagctaacaagttcgtcgcctccgatggcggacacttcatcggaggggccaacacctacttcgacctggaatcacgagacagcatcgtgcttttgggaaccgccttcaatccatcggcctcggcttccccaccgccgtaggtgtcgccacagctgctgggcaagagt

SEQ ID NO: 146 - protein, 193 aa, Corynebacterium glutamicum
LAADVATSAPARGFFHPSGNSRDLVVCGGFAATGAASEIRRANVALVLGAGLNQFTMAFGEAFGELAEVLQVDLETQTTNPRINHFISADNTTVVAAVLLKLRTQNFHAPRRLYLDDNPLTCPGGDALAADGRLDPHSLMRQLNGILPANKFVASDGGHFIGGANTYFDLESRDSIVLLGTAFNPSASASPPP

SEQ ID NO: 147 - DNA, 1315 bp, Corynebacterium glutamicum
  CDS (101)..(1285): RXA03871
taaagccttgggagcggtgattatgcttttggctgtctatgtcctcatcattggagccatcggagcgttacgattgttttccaaggtgagaaaggtttaattgatgtctcgttcgccggagcaacatttggcagaaatttcagcgctgcttcccccacaaaagtccacgttcgtgaatctgcgcgaagcgttgggacgccgcacgttttcagcggtcactgcgcagtgggattcgccacgttttgataattcccaaatggatggcttcgcgcttggcccctcacatcttaacggtggcaccttcgcagtcggtccaaccattcccgctggtcatgatcctgatcagtggtacccacgaggcatcgaaaaagacatcgcgccgattatgacgggtgcgcgccttcctaaaaacaccgccgcgatcattcctgtggagaaaaccacaccgggaaatttcgacgccccacaggtagaaatccccgccaccccgcaaggtcagttcatacggttgcagggttcggatattactgccggcgacgagatcattccagcaggtacggagcttaactcggtgcacatcggggtgttggctagtcagtcgatcaagagcattgaagtcgcagcaaagccacgtgtcctcatcatcaccggcgggtctgaaatttcagaacagcacggacccgccacgatccctgatgccaacggccctctgcttcgttccctgtgcgcccgcaacaatatcgaggtcatcgcgggactgcacaccaacgacgatcctgaacgactccgctttgaactggaaaacgccattgaccagtatcaaccggatgtcatcatcacctctggtggtatcagccacggtaaatttgaggtgtttaggcagatcctcgaaggcaccccgaactcctggtttggacatgtcgatcagcagcctggcggtcctcaaggcatctccacttttgctgaaactcctgtcatttcacttcccggaaatccgatttccaccttggtgagtttcacacttttcgtcgcgccagcgctcaaccgccagccgctccgccacctcgatgcccgcatcaccgctccggtccagggcttgcaagacaatcgcgagcaattccttcgcggcaccatcagttaccgcaacggccacgtcctcgccacgcctctcctgggcaccagttcccacctgctggttcaagctgccaccgcagactgtctgatcaggatcccggcgcggactacggtggaggaaaacgacatcgttaagatttacccattcaactaacaggagttaatttaatgagcgagctca

SEQ ID NO: 148 - protein, 395 aa, Corynebacterium glutamicum
LMSRSPEQHLAEISALLPPQKSTFVNLREALGRRTFSAVTAQWDSPRFDNSQMDGFALGPSHLNGGTFAVGPTIPAGHDPDQWYPRGIEKDIAPIMTGARLPKNTAAIIPVEKTTPGNFDAPQVEIPATPQGQFIRLQGSDITAGDEIIPAGTELNSVHIGVLASQSIKSIEVAAKPRVLIITGGSEISEQHGPATIPDANGPLLRSLCARNNIEVIAGLHTNDDPERLRFELENAIDQYQPDVIITSGGISHGKFEVFRQILEGTPNSWFGHVDQQPGGPQGISTFAETPVISLPGNPISTLVSFTLFVAPALNRQPLRHLDARITAPVQGLQDNREQFLRGTISYRNGHVLATPLLGTSSHLLVQAATADCLIRIPARTTVEENDIVKIYPFN

SEQ ID NO: 149 - DNA, 2101 bp, Corynebacterium glutamicum
  CDS (101)..(2071): RXA04120
caacgaaacaaatgcaagcccccaatcatgggtttctaccaattaaattttctttcagaaaatatctccccacataaaagttccttgataggctcgagagatgaaagtgacccaaagcacattccttaaatcggtagctgcgttcactgtcgcagccttaaccctgaccatctcttcgtgttccagcggtgaagacacctccgcaagctccacggatactgaaaactcctcaacccaagcagcagcgtctcccccacttgcgccttgtgaacttcccgccgacgcttctgctgaagaggaagtagaaggcactcacacaggtgaagatatttctgttgccccggaaatcggtaccggctaccgcgagggcatgacccctgttcaaacccaaggttatgcggtggcaactgcaaaccccatcgcttctgaagcagcctgcgcggtgttaagagaaggcggcactgcagctgatgctcttgtcaccgcgcagtttgttttgggactgacggaaccgcagtcgtctggccttggtggtggcggatacattctgtactacgacgccgaagccaatgcggtgacagccattgatggccgtgaaacagcgccagttgctgctgatgaaaactatctcattcatgtttctgcagaggatcaaacggcacctgttcctgatgcccgacgttccggcaggtcaattggtgtgccaggaatcgtggcagcccttggacagctgcatgattcattcggaaagacctcctggcaggacgtgctgacaactccgcagcagctcgcaactgatggtttttccatcagccctcgcatgtcagcatcaattgctaactccgctgaggatctctcccacgatccggaagctgccgcatatttccttgatgaaaacggtgatgcgaaggcacccggcacacttttacaaaaccctgactatgcagaaacgattcgtctcatctctgaaggtggccccgatgcgttctacacgggtgagattgcagcagacatcgtggaacgcgccacccgtgaggttgacggtttcacaccatcactgatgagcacggcagatttggctgcctacactccggaaactcgtgaagctttgtgtgctccctaccgcgacaagattgtttgtggcatgccaccgtcatcatcgggtggcgtcacagtgatggaaaccctgggtatcttgaacaactttgatctcgcccaatacccacccactgaggttggtttggatggcggattgccaaatgcggaagctgttcacctgatttcagaggctgagcgcctggcttatgctgatcgcgatgcttacatcggtgatcctgctttcgtggaagttccagcaggtggtgtcgaagagttgatcagcgatgtctacacgggtgaacgctcagaacttattgatccagagcattcaatgggtcaggcaactgctggtctgagccaggaaccagtcatggctgccctgccggaaagtggcaccagccatatttccatcatcgattcctatggcaacgcagcatcgttgaccaccagtgtggaagctgctttcggttccttccacttcacccgtggtttcattttgaataatcagctgacagatttctccgctgaaccacttgatgaggacggcgagcccgtggccaatcgtgtcgagtcagcaaagcgcccacggtcttccatgtcgccaatgctagtgttcaacgccagtggcgatggtgaaatcgcggatctgaatatggtgctgggctcccctggcggatccttgattattcagtacgtggtgaaaaccctggtcaacatcatcgactgggatatggatccacagcaggcagtgtctgcgcccaactttggtgcgatgaaccagcctaagactggactgggaagcgagcatccgctgatcgccaatgattcagcagagcttgtatctgaactggaaagcaaaggccacgaagttaatgtgggcgagcaatccagtggcctatcggcgttggtgaaaaacggcgacaccattgtcggtggcgccgatccacgtagagaaggcgtggtcttgggtggctaattagcgcgcagaccacgcagtccacag

SEQ ID NO: 150 - protein, 657 aa, Corynebacterium glutamicum
MKVTQSTFLKSVAAFTVAALTLTISSCSSGEDTSASSTDTENSSTQAAASPPLAPCELPADASAEEEVEGTHTGEDISVAPEIGTGYREGMTPVQTQGYAVATANPIASEAACAVLREGGTAADALVTAQFVLGLTEPQSSGLGGGGYILYYDAEANAVTAIDGRETAPVAADENYLIHVSAEDQTAPVPDARRSGRSIGVPGIVAALGQLHDSFGKTSWQDVLTTPQQLATDGFSISPRMSASIANSAEDLSHDPEAAAYFLDENGDAKAPGTLLQNPDYAETIRLISEGGPDAFYTGEIAADIVERATREVDGFTPSLMSTADLAAYTPETREALCAPYRDKIVCGMPPSSSGGVTVMETLGILNNFDLAQYPPTEVGLDGGLPNAEAVHLISEAERLAYADRDAYIGDPAFVEVPAGGVEELISDVYTGERSELIDPEHSMGQATAGLSQEPVMAALPESGTSHISIIDSYGNAASLTTSVEAAFGSFHFTRGFILNNQLTDFSAEPLDEDGEPVANRVESAKRPRSSMSPMLVFNASGDGEIADLNMVLGSPGGSLIIQYVVKTLVNIIDWDMDPQQAVSAPNFGAMNQPKTGLGSEHPLIANDSAELVSELESKGHEVNVGEQSSGLSALVKNGDTIVGGADPRREGVVLGG

SEQ ID NO: 151 - DNA, 886 bp, Corynebacterium glutamicum
  CDS (101)..(856): RXA04173
actgtccgaagtattggatctggtcgagggaactgtccgtaaacgcgactaaacgacccctgattcacactttcagactacaagaactagactaagcggtatggtttcagttcttttaattcagccccgtcagggagaagcagtcgccgcagctgagcgacgtgactttttgcaggccaccggtcttaagcctcaagaactgacctcccgaatgttggataccaccacttctcgaattggcagtctggaaggtttcgacggcgtgattgtgggcggaagcccactgaatgccaccaactttgagtacagcgattggcaacgccacgtccaccgcgaattgtccttgctgatcaatcacccactgccaacaatctttgtctgctacggcaatacctttttgaccttcttctctggcggacagattggtcgcacacaccccgaagattccggcgccaccacagtgttgctaactgacgccggcaaacgagacgtactcactcaagacctaccggatagctttacgtcctttactggtcacacggaaaactccgtagcgcccgcccctggacacgtggtgttggcaacgggaccaacctgccccatccagatgctgcgcgccaacaagaacacctggtcagttcaattccatgcggatatggatgccgtaggcatgaaaaaccgcatggatttttactccaactacggctacttctccccagaagattatgaccgcatcattgcagagctaccctctgttgactccatttatgccaacagggtgctccgcaacttcgtggaggtctgcgaaggaattcgtgttgctgatggtgctgagcaccaactcccaaagcttaactaatcgaggagactggtgattcgccatcca

SEQ ID NO: 152 - protein, 252 aa, Corynebacterium glutamicum
MVSVLLIQPRQGEAVAAAERRDFLQATGLKPQELTSRMLDTTTSRIGSLEGFDGVIVGGSPLNATNFEYSDWQRHVHRELSLLINHPLPTIFVCYGNTFLTFFSGGQIGRTHPEDSGATTVLLTDAGKRDVLTQDLPDSFTSFTGHTENSVAPAPGHVVLATGPTCPIQMLRANKNTWSVQFHADMDAVGMKNRMDFYSNYGYFSPEDYDRIIAELPSVDSIYANRVLRNFVEVCEGIRVADGAEHQLPKLN

SEQ ID NO: 153 - DNA, 2959 bp, Corynebacterium glutamicum
  CDS (101)..(2929): RXA04174
ccttttccacagttctgtggaatgagaatccgatgtttttctcacgccggctcagccgaagcagacgccgtcgcgaaatctcaccctaaaaaagttagaattggagctcactgtgactgaaagcaagaactccttcaatgctaagagcacccttgaagttggcgacaagtcctatgactacttcgccctctctgcagtgcctggcatggagaagctgccgtactccctcaaggttctcggagagaaccttcttcgtaccgaagacggcgcaaacatcaccaacgagcacattgaggctatcgccaactgggatgcatcttccgatccaagcatcgaaatccagttcaccccagcccgtgttctcatgcaggacttcaccggtgtcccttgtgtagttgacctcgcaaccatgcgtgaggcagttgctgcactcggtggcgaccctaacgacgtcaacccactgaacccagccgagatggtcattgaccactccgtcatcgtggaggctttcggccgcccagatgcactggctaagaacgttgagatcgagtacgagcgcaacgaggagcgttaccagttcctgcgttggggttccgagtccttctccaacttccgcgttgttcctccaggaaccggtatcgtccaccaggtcaacattgagtacttggctcgcgtcgtcttcgacaacgagggccttgcatacccagatacctgcatcggtaccgactcccacaccaccatggaaaacggcctgggcatcctgggctggggcgttggtggcattgaggctgaagcagcaatgctcggccagccagtgtccatgctgatccctcgcgttgttggcttcaagttgaccggcgagatcccagtaggcgttaccgcaactgacgttgtgctgaccatcaccgaaatgctgcgcgaccacggcgtcgtccagaagttcgttgagttctacggctccggtgttaaggctgttccactggctaaccgtgcaaccatcggcaacatgtccccagagttcggctccacctgtgcgatgttcccaatcgacgaggagaccaccaagtacctgcgcctcaccggccgcccagaagagcaggttgcactggtcgaggcttacgccaaggcgcagggcatgtggctcgacgaggacaccgttgaagctgagtactccgagtacctcgagctggacctgtccaccgttgttccttccatcgctggccctaagcgcccacaggaccgcatccttctctccgaggcaaaggagcagttccgtaaggatctgccaacctacaccgacgacgctgtttccgtagacacctccatccctgcaacccgcatggttaacgaaggtggcggacagcctgaaggcggcgtcgaagctgacaactacaacgcttcctgggctggctccggcgagtccttggctactggcgcagaaggacgtccttccaagccagtcaccgttgcatccccacagggtggcgagtacaccatcgaccacggcatggttgcaattgcatccatcacctcttgcaccaacacctctaacccatccgtgatgatcggcgctggcctgatcgcacgtaaggcagcagaaaagggcctcaagtccaagccttgggttaagaccatctgtgcaccaggttcccaggttgtcgacggctactaccagcgcgcagacctctggaaggaccttgaggccatgggcttctacctctccggcttcggctgcaccacctgtattggtaactccggcccactgccagaggaaatctccgctgcgatcaacgagcacgacctgaccgcaaccgcagttttgtccggtaaccgtaacttcgagggacgtatctcccctgacgttaagatgaactacctggcatccccaatcatggtcattgcttacgcaatcgctggcaccatggacttcgacttcgagaacgaagctcttggacaggaccaggacggcaacgacgtcttcctgaaggacatctggccttccaccgaggaaatcgaagacaccatccagcaggcaatctcccgtgagctttacgaagctgactacgcagatgtcttcaagggtgacaagcagtggcaggaactcgatgttcctaccggtgacaccttcgagtgggacgagaactccacctacatccgcaaggcaccttacttcgacggcatgcctgtcgagccagtggcagtcaccgacatccagggcgcacgcgttctggctaagctcggcgactctgtcaccaccgaccacatctcccctgcttcctccattaagccaggtacccctgcagctcagtacttggatgagcacggtgtggaacgccacgactacaactccctgggttccaggcgtggtaaccacgaggtcatgatgcgcggcaccttcgccaacatccgcctccagaaccagctggttgacatcgcaggtggctacacccgcgacttcacccaggagggtgctccacaggcgttcatctacgacgcttccgtcaactacaaggctgctggcattccgctggtcgtcttgggcggcaaggagtacggcaccggttcttcccgtgactgggcagctaagggcactaacctgctcggaattcgcgcagttatcaccgagtccttcgagcgtattcaccgctccaacctcatcggtatgggcgttgtcccactgcagttccctgcaggcgaatcccacgagtccctgggccttgacggcaccgagaccttcgacatcaccggactgaccgcactcaacgagggcgagactcctaagactgtcaaggtcaccgcaaccaaggagaacggcgacgtcgtcgagttcgacgcagttgtccgcatcgacaccccaggtgaggctgactactaccgccacggcggcatcctgcagtacgtgctgcgtcagatggctgcttcttctaagtaattagaagacttttgatgtggagtttcc

SEQ ID NO: 154 - protein, 943 aa, Corynebacterium glutamicum
LELTVTESKNSFNAKSTLEVGDKSYDYFALSAVPGMEKLPYSLKVLGENLLRTEDGANITNEHIEAIANWDASSDPSIEIQFTPARVLMQDFTGVPCVVDLATMREAVAALGGDPNDVNPLNPAEMVIDHSVIVEAFGRPDALAKNVEIEYERNEERYQFLRWGSESFSNFRVVPPGTGIVHQVNIEYLARVVFDNEGLAYPDTCIGTDSHTTMENGLGILGWGVGGIEAEAAMLGQPVSMLIPRVVGFKLTGEIPVGVTATDVVLTITEMLRDHGVVQKFVEFYGSGVKAVPLANRATIGNMSPEFGSTCAMFPIDEETTKYLRLTGRPEEQVALVEAYAKAQGMWLDEDTVEAEYSEYLELDLSTVVPSIAGPKRPQDRILLSEAKEQFRKDLPTYTDDAVSVDTSIPATRMVNEGGGQPEGGVEADNYNASWAGSGESLATGAEGRPSKPVTVASPQGGEYTIDHGMVAIASITSCTNTSNPSVMIGAGLIARKAAEKGLKSKPWVKTICAPGSQVVDGYYQRADLWKDLEAMGFYLSGFGCTTCIGNSGPLPEEISAAINEHDLTATAVLSGNRNFEGRISPDVKMNYLASPIMVIAYAIAGTMDFDFENEALGQDQDGNDVFLKDIWPSTEEIEDTIQQAISRELYEADYADVFKGDKQWQELDVPTGDTFEWDENSTYIRKAPYFDGMPVEPVAVTDIQGARVLAKLGDSVTTDHISPASSIKPGTPAAQYLDEHGVERHDYNSLGSRRGNHEVMMRGTFANIRLQNQLVDIAGGYTRDFTQEGAPQAFIYDASVNYKAAGIPLVVLGGKEYGTGSSRDWAAKGTNLLGIRAVITESFERIHRSNLIGMGVVPLQFPAGESHESLGLDGTETFDITGLTALNEGETPKTVKVTATKENGDVVEFDAVVRIDTPGEADYYRHGGILQYVLRQMAASSK

SEQ ID NO: 155 - DNA, 3793 bp, Corynebacterium glutamicum
  CDS (101)..(3763): RXA04186
agactagtggcgctttgcctgtgttgcttaggcggcgttgaaaatgaactacgaatgaaaagttcgggaattgtctaatccgtactaagctgtctacacaatgtctacttcagttacttcaccagcccacaacaacgcacattcctccgaatttttggatgcgttggcaaaccatgtgttgatcggcgacggcgccatgggcacccagctccaaggctttgacctggacgtggaaaaggatttccttgatctggaggggtgtaatgagattctcaacgacacccgccctgatgtgttgaggcagattcaccgcgcctactttgaggcgggagctgacttggttgagaccaatacttttggttgcaacctgccgaacttggcggattatgacatcgctgatcgttgccgtgagcttgcctacaagggcactgcagtggctagggaagtggctgatgagatggggccgggccgaaacggcatgcggcgtttcgtggttggttccctgggacctggaacgaagcttccatcgctgggccatgcaccgtatgcagatttgcgtgggcactacaaggaagcagcgcttggcatcatcgacggtggtggcgatgcctttttgattgagactgctcaggacttgcttcaggtcaaggctgcggttcacggcgttcaagatgccatggctgaacttgatacattcttgcccattatttgccacgtcaccgtagagaccaccggcaccatgctcatgggttctgagatcggtgccgcgttgacagcgctgcagccactgggtatcgacatgattggtctgaactgcgccaccggcccagatgagatgagcgagcacctgcgttacctgtccaagcacgccgatattcctgtgtcggtgatgcctaacgcaggtcttcctgtcctgggtaaaaacggtgcagaatacccacttgaggctgaggatttggcgcaggcgctggctggattcgtctccgaatatggcctgtccatggtgggtggttgttgtggcaccacacctgagcacatccgtgcggtccgcgatgcggtggttggtgttccagagcaggaaacctccacactgaccaagatccctgcaggccctgttgagcaggcctcccgcgaggtggagaaagaggactccgtcgcgtcgctgtacacctcggtgccattgtcccaggaaaccggcatttccatgatcggtgagcgcaccaactccaacggttccaaggcattccgtgaggcaatgctgtctggcgattgggaaaagtgtgtggatattgccaagcagcaaacccgcgatggtgcacacatgctggatctttgtgtggattacgtgggacgagacggcaccgccgatatggcgaccttggcagcacttcttgctaccagctccactttgccaatcatgattgactccaccgagccagaggttattcgcacaggccttgagcacttgggtggacgaagcatcgttaactccgtcaactttgaagacggcgatggccctgagtcccgctaccagcgcatcatgaaactggtaaagcagcacggtgcggccgtggttgcgctgaccattgatgaggaaggccaggcacgtaccgctgagcacaaggtgcgcattgctaaacgactgattgacgatatcaccggcagctacggcctggatatcaaagacatcgttgtggactgcctgaccttcccgatctctactggccaggaagaaaccaggcgagatggcattgaaaccatcgaagccatccgcgagctgaagaagctctacccagaaatccacaccaccctgggtctgtccaatatttccttcggcctgaaccctgctgcacgccaggttcttaactctgtgttcctcaatgagtgcattgaggctggtctggactctgcgattgcgcacagctccaagattttgccgatgaaccgcattgatgatcgccagcgcgaagtggcgttggatatggtctatgatcgccgcaccgaggattacgatccgctgcaggaattcatgcagctgtttgagggcgtttctgctgccgatgccaaggatgctcgcgctgaacagctggccgctatgcctttgtttgagcgtttggcacagcgcatcatcgacggcgataagaatggccttgaggatgatctggaagcaggcatgaaggagaagtctcctattgcgatcatcaacgaggaccttctcaacggcatgaagaccgtgggtgagctgtttggttccggacagatgcagctgccattcgtgctgcaatcggcagaaaccatgaaaactgcggtggcctatttggaaccgttcatggaagaggaagcagaagctaccggatctgcgcaggcagagggcaagggcaaaatcgtcgtggccaccgtcaagggtgacgtgcacgatatcggcaagaacttggtggacatcattttgtccaacaacggttacgacgtggtgaacttgggcatcaagcagccactgtccgccatgttggaagcagcggaagaacacaaagcagacgtcatcggcatgtcgggacttcttgtgaagtccaccgtggtgatgaaggaaaaccttgaggagatgaacaacgccggcgcatccaattacccagtcattttgggtggcgctgcgctgacgcgtacctacgtggaaaacgatctcaacgaggtgtacaccggtgaggtgtactacgcccgtgatgctttcgagggcctgcgcctgatggatgaggtgatggcagaaaagcgtggtgaaggacttgatcccaactcaccagaagctattgagcaggcgaagaagaaggcggaacgtaaggctcgtaatgagcgttcccgcaagattgccgcggagcgtaaagctaatgcggctcccgtgattgttccggagcgttctgatgtctccaccgatactccaaccgcggcaccaccgttctggggaacccgcattgtcaagggtctgcccttggcggagttcttgggcaaccttgatgagcgcgccttgttcatggggcagtggggtctgaaatccacccgcggcaacgagggtccaagctatgaggatttggtggaaactgaaggccgaccacgcctgcgctactggctggatcgcctgaagtctgagggcattttggaccacgtggccttggtgtatggctacttcccagcggtcgcggaaggcgatgacgtggtgatcttggaatccccggatccacacgcagccgaacgcatgcgctttagcttcccacgccagcagcgcggcaggttcttgtgcatcgcggatttcattcgcccacgcgagcaagctgtcaaggacggccaagtggacgtcatgccattccagctggtcaccatgggtaatcctattgctgatttcgccaacgagttgttcgcagccaatgaataccgcgagtacttggaagttcacggcatcggcgtgcagctcaccgaagcattggccgagtactggcactcccgagtgcgcagcgaactcaagctgaacgacggtggatctgtcgctgattttgatccagaagacaagaccaagttcttcgacctggattaccgcggcgcccgcttctcctttggttacggttcttgccctgatctggaagaccgcgcaaagctggtggaattgctcgagccaggccgtatcggcgtggagttgtccgaggaactccagctgcacccagagcagtccacagacgcgtttgtgctctaccacccagaggcaaagtactttaacgtctaacacctttgagagggaaaactttcccgc

SEQ ID NO: 156 - protein, 1221 aa, Corynebacterium glutamicum
MSTSVTSPAHNNAHSSEFLDALANHVLIGDGAMGTQLQGFDLDVEKDFLDLEGCNEILNDTRPDVLRQIHRAYFEAGADLVETNTFGCNLPNLADYDIADRCRELAYKGTAVAREVADEMGPGRNGMRRFVVGSLGPGTKLPSLGHAPYADLRGHYKEAALGIIDGGGDAFLIETAQDLLQVKAAVHGVQDAMAELDTFLPIICHVTVETTGTMLMGSEIGAALTALQPLGIDMIGLNCATGPDEMSEHLRYLSKHADIPVSVMPNAGLPVLGKNGAEYPLEAEDLAQALAGFVSEYGLSMVGGCCGTTPEHIRAVRDAVVGVPEQETSTLTKIPAGPVEQASREVEKEDSVASLYTSVPLSQETGISMIGERTNSNGSKAFREAMLSGDWEKCVDIAKQQTRDGAHMLDLCVDYVGRDGTADMATLAALLATSSTLPIMIDSTEPEVIRTGLEHLGGRSIVNSVNFEDGDGPESRYQRIMKLVKQHGAAVVALTIDEEGQARTAEHKVRIAKRLIDDITGSYGLDIKDIVVDCLTFPISTGQEETRRDGIETIEAIRELKKLYPEIHTTLGLSNISFGLNPAARQVLNSVFLNECIEAGLDSAIAHSSKILPMNRIDDRQREVALDMVYDRRTEDYDPLQEFMQLFEGVSAADAKDARAEQLAAMPLFERLAQRIIDGDKNGLEDDLEAGMKEKSPIAIINEDLLNGMKTVGELFGSGQMQLPFVLQSAETMKTAVAYLEPFMEEEAEATGSAQAEGKGKIVVATVKGDVHDIGKNLVDIILSNNGYDVVNLGIKQPLSAMLEAAEEHKADVIGMSGLLVKSTVVMKENLEEMNNAGASNYPVILGGAALTRTYVENDLNEVYTGEVYYARDAFEGLRLMDEVMAEKRGEGLDPNSPEAIEQAKKKAERKARNERSRKIAAERKANAAPVIVPERSDVSTDTPTAAPPFWGTRIVKGLPLAEFLGNLDERALFMGQWGLKSTRGNEGPSYEDLVETEGRPRLRYWLDRLKSEGILDHVALVYGYFPAVAEGDDVVILESPDPHAAERMRFSFPRQQRGRFLCIADFIRPREQAVKDGQVDVMPFQLVTMGNPIADFANELFAANEYREYLEVHGIGVQLTEALAEYWHSRVRSELKLNDGGSVADFDPEDKTKFFDLDYRGARFSFGYGSCPDLEDRAKLVELLEPGRIGVELSEELQLHPEQSTDAFVLYHPEAKYFNV

SEQ ID NO: 157 - DNA, 1468 bp, Corynebacterium glutamicum
  CDS (101)..(1438): RXA04228
tttccacacgcgttgcggattttctccgcagtggaaaaactcactcgcccaggctgcgaaaacgcccgcgacacagtggaaggggagacgccagcgacttttgcgacatcataaatggtggcttttgagtcgctgtgagccccagaatctgtcatgcacaagagtatatagcgcaaaagaaatcactagtcttgattctatgttgacgatgccgatacccgagtacctgcacgaaattttagatgatgtccgcgacaccacctccggcgagttggccgattacatcccggaactaaaatctgcggacccaaacccgctggcagtagccctgtgcaccgttaacggacacatctacagcgcaggcgatgacgacatcgaattcaccatgcaaagtatttccaagccatttgcctacgcactcgcactccaagaatgcggctttgatgaggtctctgcatccgtggccttggagccctccggtgaggccttcaacgaactttccctcgacggcgaaaaccgccccatgaaccccatgatcaacgccggcgcgatcgccatcaaccagctgatcaacggctccgattccaccgtggaagaccgcgtggaaaaaatccgacactacttctctgaacttgctggacgcgaactcaccatcgaccgcgtgcttgccgaatccgaactcgccggcgccgaccgcaacctctccatcgcccacatgctgcgcaattacggcgtcatcgaagacgaagcccacgacgccgtcctcagctacacgctgcaatgcgccatcaaagtaaccacgcgcgacctcgcagtcatgaccgccacgctcgccgccggcggcacacacccaattaccggcaagaagcttctcgacgcccgcgtctgccgcctcaccctctccgtcatggcttcagcaggcatgtacgacgaggcagggcagtggctctccaccgtaggcatccccgcgaaatcaggagtcgccggcggactcatcggcattctgccaggtcagctgggcatcgccacattttccccacgcctgaaccccaaaggcaacagcgtgcgcggcgtaaaaatattcaaacagctttccgacgacatgggcctccacctcatgtccaccgagcaggtatccggccacgcagtacgatccatcacgcgggacggcgacaccaccttcatccaaatgcagggcgccatgaacttctccgccagcgaaagcttcctccacgccatcgtggaacacaactttgaaggcaccgaagttgttcttgatctcacccgagtacttagcttccaccccgtagccatccgcatgatcaaagaaggcctcaaacgcatccgcgacgcaggctttgaggtgttcatcctcgacccagatgacgtactgcccgatttcatgttttccgacggcaccatctgcaaagaacgagtgtgaccggtagctttatgggctgaacaattc

SEQ ID NO: 158 - protein, 446 aa, Corynebacterium glutamicum
LRHHKWWLLSRCEPQNLSCTRVYSAKEITSLDSMLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 159 - DNA, 1174 bp, Corynebacterium glutamicum
  CDS (101)..(1144): RXA04360
cagtttcaccctgagtcagtgctaagcccaacgggtcctgtcattttgtcccgctgtgtcgaacagcttctcgcgaactaataaaaaaaggatttgattcatgacttctccagcaacactgaaagttctcaacgcctacttggataaccccactccaaccctggaggaggcaattgaggtgttcaccccgctgaccgtgggtgaatacgatgacgtgcacatcgcagcgctgcttgccaccatccgtactcgcggtgagcagttcgctgatattgccggcgctgccaaggcgttcctcgcggcggctcgtccgttcccgattactggcgcaggtttgctagattccgctggtactggtggcgacggtgccaacaccatcaacatcaccaccggcgcatccctgatcgcagcatccggtggagtgaagctggttaagcacggcaaccgttcggtgagctccaagtccggctccgccgatgtgctggaagcgctgaatattcctttgggccttgatgtggatcgtgctgtgaagtggttcgaagcgtccaacttcaccttcctgttcgcacctgcgtacaaccctgcgattgcgcatgtgcagccggttcgccaggcgctgaaattccccaccatcttcaacacgcttggaccattgctgtccccggcgcgcccggagcgtcagatcatgggcgtggccaatgccaatcatggacagctcatcgccgaggtcttccgcgagttgggccgtacacgcgcgcttgttgtgcatggcgcaggcaccgatgagatcgcagtccacggcaccaccttggtgtgggagcttaaagaagacggcaccatcgagcattacaccatcgagcctgaggaccttggccttggccgctacacccttgaggatctcgtaggtggcctcggcactgagaacgccgaagctatgcgcgctactttcgcgggcaccggccctgatgcacaccgtgatgcgttggctgcgtccgcaggtgcgatgttctacctcaacggcgatgtcgactccttgaaagatggtgcacaaaaggcgctttccttgcttgccgacggcaccacccaggcatggttggccaagcacgaagagatcgattactcagaaaaggagtcttccaatgactagtaataatctgcccacagtgttggaaag

SEQ ID NO: 160 - protein, 348 aa, Corynebacterium glutamicum
MTSPATLKVLNAYLDNPTPTLEEAIEVFTPLTVGEYDDVHIAALLATIRTRGEQFADIAGAAKAFLAAARPFPITGAGLLDSAGTGGDGANTINITTGASLIAASGGVKLVKHGNRSVSSKSGSADVLEALNIPLGLDVDRAVKWFEASNFTFLFAPAYNPAIAHVQPVRQALKFPTIFNTLGPLLSPARPERQIMGVANANHGQLIAEVFRELGRTRALVVHGAGTDEIAVHGTTLVWELKEDGTIEHYTIEPEDLGLGRYTLEDLVGGLGTENAEAMRATFAGTGPDAHRDALAASAGAMFYLNGDVDSLKDGAQKALSLLADGTTQAWLAKHEEIDYSEKESSND

SEQ ID NO: 161 - DNA, 4530 bp, Corynebacterium glutamicum
  CDS (1)..(4530): RXA07000
atgaaaccacaaggactctacaaccctgcgcatgaacatgacgcctgcggtgtggcgtttattgcggatatccacggtcgacccagccgcagcattgttgatcgtgcacttgaggcgcttcgcaacattgaccaccgaggtgccgccggtgcagagaagaacactggcgatggtgcgggcatcctcatgcagattccggacggcttttatcgtgaagtatctggcattgagcttcctgaggcaggggagtatgccactggtattgcgttcttgcctcgcggtcgcatggcgatgatggatgctcagaaggaaattgagcgcatcgcaaagcaagaaggtgccgatgtgcttggttggcgcatggttccttttgattctcgtgatttgggttccatggctgaggaggcgatgcctagtttcgcgcagattttccttactgtgcctggaaaatctggtgaagatcttgaccgtgtgatgttctttatccgtaagcgttgtgagcgtgagctgggcaccaccaatggtcgcgatacggtgtatttcccgtcgctatcttcacgcaccatcatttacaaaggcatgttgaccactctgcagcttgagggcttctttgaggatctgggtgatgctcgcctggagtcggccattgctattgtgcactcgcgtttctccacgaacactttcccaagctggccgctggcgcacccgtaccgtttcgttgcccacaacggtgagatcaacactgtgcgtggcaatgaaaactggatgcgcgcccgcgaggcgcttatcaaaaacgacaagctgggcaatttgagcagcgtgctgcctatctgcaccccggagggctcggataccgcgcgtttcgacgaggctttggagcttttgcacctgggcggatactcacttccgcatgctgttgcgatgatgatccctcaggcgtgggaacacaacaagacgctgagccctgagctgcgtgatttctacgaataccactcttgtctgatggagccatgggatggtcctgcagcgctggcatttactgacggtcgttttgtgggtgccgtgctggaccgtaatggcctgcgacctgggcgaatcaccattactgattcgggtttggttgtgatggcttctgaatcgggagtgttggacttgagggaggagagcgtcgtaaagcgtactcgcgtacagcctggacgcatgttccttgttgacactgccgagggccgcatcgttgaagacgaggaaatcaagcagaaattaagcgaagcgcagccatatggtgagtggattcgcgataattttgtgcatctggatcgtctgcctcagacacgctacaactacatggcgcactctcgtgctgtgttgcgtcagcgtgttttcggaatcactgaagaagatgtggatttgttgctgctgccgatggcccgccagggtgctgaggcgattggttccatgggttcggatacgccaattgcggcgctatcccagcgaccacgcatgctttatgatttcttcgcgcagcgctttgctcaggtgacaaacccaccgttggactctatccgcgaaaagcctgtgaccagcatgttcactttgttgggtgcgcagtctgacgtgctcaatccgggtcctgatgcggcgcgacgtatccgtttggaatcgccgatcattgataaccatgagctggccaccttgatcaatgccaacgcgcatggtgagtgggattcctttggtgctgctgtaatttctggtttgtacccagtggctcaccatggtgccggcatgaaggctgcgattgctcgtgtgcgccgcgaggtttctgaagcaatccgcaatggcaagacgttgatcgtgctgtcggatcgtgaatctgatgagcgcatggcacctatccctgcgctgctgctgacttccgctgtgcatcagtacttggtgcagcaacgtacccgtacccagtgctccctggtggtggaatccggcgatgcccgcgaggttcatcacctggcgatgctcattggttttggtgccgatgcgatcaacccgtacatggcatttgaaaccatcgatgagctgcgcatgaagggtcagttgggtgatctttctttggatgaggcatcccgaaactacatcaaggcagccaccactggtgtgctgaaggtgatgtccaagatgggcattgcaacggtgtcttcgtaccgtggcgcgcagcttgccgatgtcactggtctgcaccaggatctcctggacaactacttcggtggtattgcttcaccaatttctggcatcggtctggatgaagttgcagctgacgtagaagctcgtcaccgcagcgcatttttgccacgccctgaagagcacgctcaccgtgaattggatttgggtggtgaatacaagtggcgccgcgaaggtgaataccacctgttcaacccagaaaccatcttcaagctgcagcatgcaacgcgttctggcagctacgagattttcaaggattacacccgcaaggttgatgatcaatccactcgcttgggtactattcgtggactgtttgagttcagcacggaccgcaagccaatttcggtgtctgaggtggagccggtcagtgagatcgtgaagcgtttctccactggtgcgatgtcttatggctcgatttctgctgaagcccatgaggtcttggccatcgccatgaaccgactgggcggtatgtccaactccggcgaaggtggcgaggacgcccgccgatttgatgtggaacccaacggtgactggaagcgctctgccattaagcaggtggcctcgggacgtttcggcgtgaccagccactacttgaacaactgcaccgatattcagatcaagatggcacagggcgcaaagcccggtgaaggtggccagctgccaccaaacaaggtgtacccatgggttgcagaagtccgcatcaccaccccaggcgttggtctgatttcccctccaccacaccacgatatttactccattgaggatctggctcagctgatccacgacctgaagaacgctaacccacgcgcacgaatccacgtgaagctagtggcagaacaaggcgtgggcaccgttgccgcaggtgtgtccaaagcacacgctgatgtggtgcttatttccggccacgatggcggaactggcgcatctcctttgacctccctgaagcatgccggtggtccatgggagttgggcttggctgaaacccagcaaacgttgctgctcaacggcctgcgcgatcgtattcgcgtgcagtgcgatggtcagctgaaaactggccgagacgtggttatcgcagctcttctcggtgccgaagaattcggttttgccaccgcaccgctggtggttgaaggctgcatcatgatgcgcgtctgccacctggacacctgcccggtgggtatcgctacccagaacccggatttgcgttccaagttcaccggcaaggctgaacacgtggtcaacttcttcaccttcatcgcccaggaagtccgtgagtacttggcacagcttggtttccgctctattgatgaagccgtcggacaagcccaggtgctgcgcaagcgttccggaatcccagctgattcccgcgcagcacacctggatttgagcccaattttccatcgcccagaaactccacacttcccaactcaggatgtgcgttgcaccaagacccaggaacacagcctagaaaaagccctggacaacgcatttattgataaggcttcggacacgatcacccgtgccgcagcgggtgtggaaaccagcattgttattgatagctccatcagcaacgtcaaccgttcagttggcacgatgctgggttctgcagtcagccgcgtggctggtgcccaaggtttgccagacggcaccatcaccttgaatcttcaaggctgcgccggtaactcctttggcgcgttcatcccacgaggcatcaccatcaacctcaccggcgatgccaatgactttgtgggcaagggattatctggcggaaagattgtgatcaagccttccgctcaggctccgaagcagctgaagaacaatccaaatatcattgccggaaacgtgcttggatacggcgcaaccagtggtgaattgttcattcgtggccaggtcggcgaacgtttctgcgtccgtaactctggcgccaccgcagtggttgaaggtatcggaaaccacggttgtgagtacatgactggcggccgagtcctggttttgggcccggttggtgagaactttggtgccggcatgtctggtggcattgcatacctggctaattccccggacctaaaccagaagatcaatggcgaattggtggatgttgttccactgagcgctgacgatctgacgtgggctgatgagctcattgctcgccaccgcgaactcaccggatccgagaccaagctgcgtgcacaagatttggtgaaaatcatgccgcgcgatttccaaaaagtactcaacatcatcgaaacggcccacgctgagggccaagacccagcaatcaagatcatggaggcagtgagc

SEQ ID NO: 162 - protein, 1510 aa, Corynebacterium glutamicum
MKPQGLYNPAHEHDACGVAFIADIHGRPSRSIVDRALEALRNIDHRGAAGAEKNTGDGAGILMQIPDGFYREVSGIELPEAGEYATGIAFLPRGRMAMMDAQKEIERIAKQEGADVLGWRMVPFDSRDLGSMAEEAMPSFAQIFLTVPGKSGEDLDRVMFFIRKRCERELGTTNGRDTVYFPSLSSRTIIYKGMLTTLQLEGFFEDLGDARLESAIAIVHSRFSTNTFPSWPLAHPYRFVAHNGEINTVRGNENWMRAREALIKNDKLGNLSSVLPICTPEGSDTARFDEALELLHLGGYSLPHAVAMMIPQAWEHNKTLSPELRDFYEYHSCLMEPWDGPAALAFTDGRFVGAVLDRNGLRPGRITITDSGLVVMASESGVLDLREESVVKRTRVQPGRMFLVDTAEGRIVEDEEIKQKLSEAQPYGEWIRDNFVHLDRLPQTRYNYMAHSRAVLRQRVFGITEEDVDLLLLPMARQGAEAIGSMGSDTPIAALSQRPRMLYDFFAQRFAQVTNPPLDSIREKPVTSMFTLLGAQSDVLNPGPDAARRIRLESPIIDNHELATLINANAHGEWDSFGAAVISGLYPVAHHGAGMKAAIARVRREVSEAIRNGKTLIVLSDRESDERMAPIPALLLTSAVHQYLVQQRTRTQCSLVVESGDAREVHHLAMLIGFGADAINPYMAFETIDELRMKGQLGDLSLDEASRNYIKAATTGVLKVMSKMGIATVSSYRGAQLADVTGLHQDLLDNYFGGIASPISGIGLDEVAADVEARHRSAFLPRPEEHAHRELDLGGEYKWRREGEYHLFNPETIFKLQHATRSGSYEIFKDYTRKVDDQSTRLGTIRGLFEFSTDRKPISVSEVEPVSEIVKRFSTGAMSYGSISAEAHEVLAIAMNRLGGMSNSGEGGEDARRFDVEPNGDWKRSAIKQVASGRFGVTSHYLNNCTDIQIKMAQGAKPGEGGQLPPNKVYPWVAEVRITTPGVGLISPPPHHDIYSIEDLAQLIHDLKNANPRARIHVKLVAEQGVGTVAAGVSKAHADVVLISGHDGGTGASPLTSLKHAGGPWELGLAETQQTLLLNGLRDRIRVQCDGQLKTGRDVVIAALLGAEEFGFATAPLVVEGCIMMRVCHLDTCPVGIATQNPDLRSKFTGKAEHVVNFFTFIAQEVREYLAQLGFRSIDEAVGQAQVLRKRSGIPADSRAAHLDLSPIFHRPETPHFPTQDVRCTKTQEHSLEKALDNAFIDKASDTITRAAAGVETSIVIDSSISNVNRSVGTMLGSAVSRVAGAQGLPDGTITLNLQGCAGNSFGAFIPRGITINLTGDANDFVGKGLSGGKIVIKPSAQAPKQLKNNPNIIAGNVLGYGATSGELFIRGQVGERFCVRNSGATAVVEGIGNHGCEYMTGGRVLVLGPVGENFGAGMSGGIAYLANSPDLNQKINGELVDVVPLSADDLTWADELIARHRELTGSETKLRAQDLVKIMPRDFQKVLNIIETAHAEGQDPAIKIMEAVS

SEQ ID NO: 163 - DNA, 1455 bp, Corynebacterium glutamicum
  CDS (1)..(1455): RXA07001
atgaagtacttggtggcgctgggaagaagccttcgttatgggaggtctcccagacacaatcgaatacgggccggatatccatctcggctcatcaccccgctttttatcaagaaagatgaggacctcttgaagcgtcttactcgcatcgcatccatcagcatggcctccatgctcgccgccgcaagtctcgtcgcgtgctccggctccaccgacgaggaaggcgatgtttacttcctgaacttcaagcctgaacaggacgtggcataccaggaaatcgcaaaggcctacactgaagagaccggcgttaaggtcaaggtcgttactgccgcctccggctcctatgagcagaccctcaaggccgagattggcaaggacgaagccccgactctcttccaggtcaatggcccagccggcttcatcacttggcaggactacatggcagatatgtcggacaccgaggtagctaagcagctgaccgacgacattccgccgctgaccaccgaggatggcgaggtacgtggcgttccgttcgccgtcgagggcttcggcatcatctacaacgacgagatcttcgacaagtacatcgccacgtccggcgcaaagatcaagtccacggatgagatcacgagctaccagaagctcaaggaagtcgccgaggatatgcaggcaaagaaggacgagctcggtatcgaaggcgccttcgcctccacctcgctgacatccggtgaggactggcgttggcagacccacctggccaacgctccgatctggcaggagtaccaggacaagggagtcgaggacaccaacgagatcgagttctcctacaacaaggagtacaagaaccttttcgatctctaccttgagaactccaccgtagaaaagtctcttgcgccgtctaagacggtgtctgattccatggctgagttcgcacagggcaaggccgctatggttcagaacggtaactgggcatggtcccagatttccgagacttctggcaacgtggtcaaggaagacaagatcaagttcctgcccatgtacatgggtctgccagatgaagaaaagcacggcatcaacgtcggtaccgagaactatttgggcgtgaactctgaggcctccgaggtcgaccagcaggccaccaaggacttcgtggattggctgtttacctctgaagctggcaaggagcacgtggtgaaggaccttggcttcatcgcaccgttcgaaagctacaccgctgagaacaccccgaatgaccccctttctgagcaagtcgcggaagctatcgctaacaaggatctgaccacctacccgtggaacttccagtacttcccgtcccagcagttcaaggatgacttcggccaggatctgtcgcagtacgcctccggaaagctgaagtgggaggacgtcgtcaagcacttcaatgacaactgggctgctgagaaggaatccaactggggc

SEQ ID NO: 164 - protein, 485 aa, Corynebacterium glutamicum
MKYLVALGRSLRYGRSPRHNRIRAGYPSRLITPLFIKKDEDLLKRLTRIASISMASMLAAASLVACSGSTDEEGDVYFLNFKPEQDVAYQEIAKAYTEETGVKVKVVTAASGSYEQTLKAEIGKDEAPTLFQVNGPAGFITWQDYMADMSDTEVAKQLTDDIPPLTTEDGEVRGVPFAVEGFGIIYNDEIFDKYIATSGAKIKSTDEITSYQKLKEVAEDMQAKKDELGIEGAFASTSLTSGEDWRWQTHLANAPIWQEYQDKGVEDTNEIEFSYNKEYKNLFDLYLENSTVEKSLAPSKTVSDSMAEFAQGKAAMVQNGNWAWSQISETSGNVVKEDKIKFLPMYMGLPDEEKHGINVGTENYLGVNSEASEVDQQATKDFVDWLFTSEAGKEHVVKDLGFIAPFESYTAENTPNDPLSEQVAEAIANKDLTTYPWNFQYFPSQQFKDDFGQDLSQYASGKLKWEDVVKHFNDNWAAEKESNWG

We claim:

1. An isolated nucleic acid molecule selected from the group consisting of:
   a) an isolated nucleic acid molecule encoding the amino acid sequence set forth in SEQ ID NO:2, wherein the amino acid residue at position 26 of SEQ ID NO:2 is any amino acid except for leucine, or a complement thereof;
   b) an isolated nucleic acid molecule comprising the nucleotide sequence set forth in SEQ ID NO:1, wherein the nucleic acid molecule comprises one or more nucleic acid modifications as compared to the nucleotide sequence set forth in SEQ ID NO:1 such that nucleotide residues 176–178 of SEQ ID NO:1 encode any amino acid except leucine, or a complement thereof;
   c) an isolated nucleic acid molecule comprising the nucleotide sequence set forth in SEQ ID NO:1, wherein the nucleic acid molecule comprises one or more nucleic acid modifications at nucleotide residues 176–178 of SEQ ID NO:1 such that nucleotide residues 176–178 of SEQ ID NO:1 encode any amino acid except leucine, or a complement thereof.

2. The isolated nucleic acid molecule of claim 1 (a) wherein the amino acid residue at position 26 of SEQ ID NO:2 is phenylalanine.

3. A vector comprising the nucleic acid molecule of claim 1.

4. The vector of claim 3, which is an expression vector.

5. An isolated host cell, which is transfected with the vector of claim 4.

6. The host cell of claim 5, wherein the expression of said nucleic acid molecule modulates the production of a fine chemical from said cell.

7. A method for preparing a fine chemical, comprising culturing the cell of claim 5 such that the fine chemical is produced.

8. The method of claim 7, wherein the fine chemical is an amino acid.

9. The method of claim 8, wherein said amino acid is lysine.

10. The nucleic acid molecule of claim 1(b) or (c), wherein nucleotide residues 176–178 of SEQ ID NO:1 encode phenylalanine.

11. The host cell of claim 5, wherein said cell is a microorganism.

12. The host cell of claim 11, wherein said cell belongs to the genus *Corynebacterium* or *Brevibacterium*.

13. The host cell of claim 6, wherein said fine chemical is selected from the group consisting of organic acids, proteinogenic and nonproteinogenic amino acids, purine and pyrimidine bases, nucleosides, nucleotides, lipids, saturated and unsaturated fatty acids, diols, carbohydrates, aromatic compounds, vitamins, cofactors and enzymes.

14. The method of claim 7, wherein said cell belongs to the genus *Corynebacterium* or *Brevibacterium*.

15. The method of claim 7, wherein expression of the nucleic acid molecule from said vector results in modulation of production of said fine chemical.

16. The method of claim 7, wherein said fine chemical is selected from the group consisting of organic acids, proteinogenic and nonproteinogenic amino acids, purine and pyrimidine bases, nucleosides, nucleotides, lipids, saturated and unsaturated fatty acids, diols, carbohydrates, aromatic compounds, vitamins, cofactors and enzymes.

17. A method for producing a fine chemical, comprising culturing a cell whose genomic DNA has been altered by the inclusion of a nucleic acid molecule of claim 1.

* * * * *